United States Patent 12,624,385 (RIBOREGULATORS AND METHODS OF USE THEREOF) - sequence listing, part 15

SEQ ID NO: 239794 - DNA, 103 bp, Artificial Sequence
  Synthetic Polynucleotide
taatacgactcactatagggtgcccccttcttgctgctccgcagcaggacaacagaggagagtcctgatgcggagcagcaacctggcggcagcgcaaaagatg

SEQ ID NO: 239795 - DNA, 103 bp, Artificial Sequence
  Synthetic Polynucleotide
taatacgactcactatagggcggacccctctgcccccttcttgctgctccaacagaggagaggagcaatgagaagggggaacctggcggcagcgcaaaagatg

SEQ ID NO: 239796 - DNA, 103 bp, Artificial Sequence
  Synthetic Polynucleotide
taatacgactcactatagggggggcgcatgcggacccctctgcccccttcaacagaggagagaagggatgagaggggtcaacctggcggcagcgcaaaagatg

SEQ ID NO: 239797 - DNA, 103 bp, Artificial Sequence
  Synthetic Polynucleotide
taatacgactcactatagggggcctcccccggggcgcatgcggacccctcaacagaggagagaggggatggcatgcgccaacctggcggcagcgcaaaagatg

SEQ ID NO: 239798 - DNA, 103 bp, Artificial Sequence
  Synthetic Polynucleotide
taatacgactcactatagggggccccggccggccctggtggggctggggcaacagaggagagccccaatgccaccagggaacctggcggcagcgcaaaagatg

SEQ ID NO: 239799 - DNA, 103 bp, Artificial Sequence
  Synthetic Polynucleotide
taatacgactcactatagggccgctgccttggcctcccccggggcgcatgaacagaggagacatgcgatgcgggggaggaacctggcggcagcgcaaaagatg

SEQ ID NO: 239800 - DNA, 103 bp, Artificial Sequence
  Synthetic Polynucleotide
taatacgactcactataggggagcactggaccgctgccttggcctcccccaacagaggagagggggaatgcaaggcagcaacctggcggcagcgcaaaagatg

SEQ ID NO: 239801 - DNA, 103 bp, Artificial Sequence
  Synthetic Polynucleotide
taatacgactcactatagggcttgcagaaggagcactggaccgctgccttaacagaggagaaaggcaatggtccagtgcaacctggcggcagcgcaaaagatg

SEQ ID NO: 239802 - DNA, 103 bp, Artificial Sequence
  Synthetic Polynucleotide
taatacgactcactatagggcgaactggctcttgcagaaggagcactggaaacagaggagatccagtatgccttctgcaaacctggcggcagcgcaaaagatg

SEQ ID NO: 239803 - DNA, 103 bp, Artificial Sequence
  Synthetic Polynucleotide
taatacgactcactatagggttcttacgctcgaactggctcttgcagaagaacagaggagacttctgatggagccagttaacctggcggcagcgcaaaagatg

SEQ ID NO: 239804 - DNA, 103 bp, Artificial Sequence
  Synthetic Polynucleotide
taatacgactcactatagggctccaggtccttcttacgctcgaactggctaacagaggagaagccagatggagcgtaagaacctggcggcagcgcaaaagatg

SEQ ID NO: 239805 - DNA, 103 bp, Artificial Sequence
  Synthetic Polynucleotide
taatacgactcactataggggcacgtgcagctccaggtccttcttacgctaacagaggagaagcgtaatgaggacctggaacctggcggcagcgcaaaagatg

SEQ ID NO: 239806 - DNA, 103 bp, Artificial Sequence
  Synthetic Polynucleotide
taatacgactcactatagggtgcgcctggtgcacgtgcagctccaggtccaacagaggagaggacctatggctgcacgtaacctggcggcagcgcaaaagatg

SEQ ID NO: 239807 - DNA, 103 bp, Artificial Sequence
  Synthetic Polynucleotide
taatacgactcactataggggaacggcttgtgcgcctggtgcacgtgcagaacagaggagactgcacatgcaccaggcgaacctggcggcagcgcaaaagatg

SEQ ID NO: 239808 - DNA, 103 bp, Artificial Sequence
  Synthetic Polynucleotide
taatacgactcactataggggcctgcacttgaacggcttgtgcgcctggtaacagaggagaaccaggatgacaagccgtaacctggcggcagcgcaaaagatg

SEQ ID NO: 239809 - DNA, 103 bp, Artificial Sequence
  Synthetic Polynucleotide
taatacgactcactatagggtccacctcgtggccccggccggccctggtgaacagaggagacaccagatgcggccggggaacctggcggcagcgcaaaagatg

SEQ ID NO: 239810 - DNA, 103 bp, Artificial Sequence
  Synthetic Polynucleotide
taatacgactcactatagggtagctgcacagcctgcacttgaacggcttgaacagaggagacaagccatgcaagtgcagaacctggcggcagcgcaaaagatg

SEQ ID NO: 239811 - DNA, 103 bp, Artificial Sequence
  Synthetic Polynucleotide
taatacgactcactatagggcagcgtcgcgtagctgcacagcctgcacttaacagaggagaaagtgcatgctgtgcagcaacctggcggcagcgcaaaagatg

SEQ ID NO: 239812 - DNA, 103 bp, Artificial Sequence
  Synthetic Polynucleotide
taatacgactcactatagggactcctcccgcagcgtcgcgtagctgcacaaacagaggagatgtgcaatgacgcgacgcaacctggcggcagcgcaaaagatg

SEQ ID NO: 239813 - DNA, 103 bp, Artificial Sequence
  Synthetic Polynucleotide
taatacgactcactatagggctcagcagcgactcctcccgcagcgtcgcgaacagaggagacgcgacatggcgggaggaaacctggcggcagcgcaaaagatg

SEQ ID NO: 239814 - DNA, 103 bp, Artificial Sequence
  Synthetic Polynucleotide
taatacgactcactatagggctcgatgtggctcagcagcgactcctcccgaacagaggagacgggagatgtcgctgctgaacctggcggcagcgcaaaagatg

SEQ ID NO: 239815 - DNA, 103 bp, Artificial Sequence
  Synthetic Polynucleotide
taatacgactcactatagggtgtggtccctctcgatgtggctcagcagcgaacagaggagacgctgcatggccacatcgaacctggcggcagcgcaaaagatg

SEQ ID NO: 239816 - DNA, 103 bp, Artificial Sequence
  Synthetic Polynucleotide
taatacgactcactatagggtgcgcggtgatgtggtccctctcgatgtggaacagaggagaccacatatggagggaccaaacctggcggcagcgcaaaagatg

SEQ ID NO: 239817 - DNA, 103 bp, Artificial Sequence
  Synthetic Polynucleotide
taatacgactcactataggggccgggcccctgcgcggtgatgtggtccctaacagaggagaagggacatgatcaccgcgaacctggcggcagcgcaaaagatg

SEQ ID NO: 239818 - DNA, 103 bp, Artificial Sequence
  Synthetic Polynucleotide
taatacgactcactatagggcctcgccgctgccgggcccctgcgcggtgaaacagaggagatcaccgatgaggggcccgaacctggcggcagcgcaaaagatg

SEQ ID NO: 239819 - DNA, 103 bp, Artificial Sequence
  Synthetic Polynucleotide
taatacgactcactatagggtccacgcaggcctcgccgctgccgggccccaacagaggagaggggccatgcagcggcgaaacctggcggcagcgcaaaagatg

SEQ ID NO: 239820 - DNA, 103 bp, Artificial Sequence
  Synthetic Polynucleotide
taatacgactcactatagggcttgtccccatccacctcgtggccccggccaacagaggagaggccggatgcacgaggtgaacctggcggcagcgcaaaagatg

SEQ ID NO: 239821 - DNA, 103 bp, Artificial Sequence
  Synthetic Polynucleotide
taatacgactcactatagggcttgccgttctccacgcaggcctcgccgctaacagaggagaagcggcatggcctgcgtgaacctggcggcagcgcaaaagatg

SEQ ID NO: 239822 - DNA, 103 bp, Artificial Sequence
  Synthetic Polynucleotide
taatacgactcactatagggtcagctcgggcttgccgttctccacgcaggaacagaggagacctgcgatgagaacggcaaacctggcggcagcgcaaaagatg

SEQ ID NO: 239823 - DNA, 103 bp, Artificial Sequence
  Synthetic Polynucleotide
taatacgactcactatagggtccccggggctcagctcgggcttgccgttcaacagaggagagaacggatggcccgagctaacctggcggcagcgcaaaagatg

SEQ ID NO: 239824 - DNA, 103 bp, Artificial Sequence
  Synthetic Polynucleotide
taatacgactcactataggggcacgggaactccccggggctcagctcgggaacagaggagacccgagatgagccccgggaacctggcggcagcgcaaaagatg

SEQ ID NO: 239825 - DNA, 103 bp, Artificial Sequence
  Synthetic Polynucleotide
taatacgactcactatagggcacacacctcgcacgggaactccccggggcaacagaggagagccccgatgagttcccgtaacctggcggcagcgcaaaagatg

SEQ ID NO: 239826 - DNA, 103 bp, Artificial Sequence
  Synthetic Polynucleotide
taatacgactcactatagggaaggcctggccacacacctcgcacgggaacaacagaggagagttcccatgcgaggtgtgaacctggcggcagcgcaaaagatg

SEQ ID NO: 239827 - DNA, 103 bp, Artificial Sequence
  Synthetic Polynucleotide
taatacgactcactatagggggtctggctgaaggcctggccacacacctcaacagaggagagaggtgatgggccaggccaacctggcggcagcgcaaaagatg

SEQ ID NO: 239828 - DNA, 103 bp, Artificial Sequence
  Synthetic Polynucleotide
taatacgactcactatagggtcaggaaccaggtctggctgaaggcctggcaacagaggagagccaggatgtcagccagaaacctggcggcagcgcaaaagatg

SEQ ID NO: 239829 - DNA, 103 bp, Artificial Sequence
  Synthetic Polynucleotide
taatacgactcactatagggatgtgcgccttcaggaaccaggtctggctgaacagaggagacagccaatgctggttcctaacctggcggcagcgcaaaagatg

SEQ ID NO: 239830 - DNA, 103 bp, Artificial Sequence
  Synthetic Polynucleotide
taatacgactcactataggggtgcttcttcatgtgcgccttcaggaaccaaacagaggagatggttcatgaaggcgcacaacctggcggcagcgcaaaagatg

SEQ ID NO: 239831 - DNA, 103 bp, Artificial Sequence
  Synthetic Polynucleotide
taatacgactcactatagggggcaggtagccttgtccccatccacctcgtaacagaggagaacgaggatgatggggacaaacctggcggcagcgcaaaagatg

SEQ ID NO: 239832 - DNA, 103 bp, Artificial Sequence
  Synthetic Polynucleotide
taatacgactcactatagggaggagccccggtgcttcttcatgtgcgcctaacagaggagaaggcgcatgtgaagaagcaacctggcggcagcgcaaaagatg

SEQ ID NO: 239833 - DNA, 103 bp, Artificial Sequence
  Synthetic Polynucleotide
taatacgactcactatagggccgtggtcgaaggagccccggtgcttcttcaacagaggagagaagaaatgccggggctcaacctggcggcagcgcaaaagatg

SEQ ID NO: 239834 - DNA, 103 bp, Artificial Sequence
  Synthetic Polynucleotide
taatacgactcactataggggatgtggcagccgtggtcgaaggagccccgaacagaggagacggggcatgttcgaccacaacctggcggcagcgcaaaagatg

SEQ ID NO: 239835 - DNA, 103 bp, Artificial Sequence
  Synthetic Polynucleotide
taatacgactcactatagggtacggccgcagatgtggcagccgtggtcgaaacagaggagatcgaccatggctgccacaaacctggcggcagcgcaaaagatg

SEQ ID NO: 239836 - DNA, 103 bp, Artificial Sequence
  Synthetic Polynucleotide
taatacgactcactatagggtccttgaacctacggccgcagatgtggcagaacagaggagactgccaatgctgcggccgaacctggcggcagcgcaaaagatg

SEQ ID NO: 239837 - DNA, 103 bp, Artificial Sequence
  Synthetic Polynucleotide
taatacgactcactataggggaaccagggctccttgaacctacggccgcaaacagaggagatgcggcatgaggttcaagaacctggcggcagcgcaaaagatg

SEQ ID NO: 239838 - DNA, 103 bp, Artificial Sequence
  Synthetic Polynucleotide
taatacgactcactatagggggttcttgaggaaccagggctccttgaaccaacagaggagaggttcaatgagccctggtaacctggcggcagcgcaaaagatg

SEQ ID NO: 239839 - DNA, 103 bp, Artificial Sequence
  Synthetic Polynucleotide
taatacgactcactataggggccttcatgtggttcttgaggaaccagggcaacagaggagagccctgatgcctcaagaaaacctggcggcagcgcaaaagatg

SEQ ID NO: 239840 - DNA, 103 bp, Artificial Sequence
  Synthetic Polynucleotide
taatacgactcactatagggggggccgtgcgccttcatgtggttcttgagaacagaggagactcaagatgcacatgaagaacctggcggcagcgcaaaagatg

SEQ ID NO: 239841 - DNA, 103 bp, Artificial Sequence
  Synthetic Polynucleotide
taatacgactcactatagggtgcccgtcttggggccgtgcgccttcatgtaacagaggagaacatgaatgcgcacggccaacctggcggcagcgcaaaagatg

SEQ ID NO: 239842 - DNA, 103 bp, Artificial Sequence
  Synthetic Polynucleotide
taatacgactcactatagggcagcaggtgtggcaggtagccttgtccccaaacagaggagatggggaatgggctacctgaacctggcggcagcgcaaaagatg

SEQ ID NO: 239843 - DNA, 103 bp, Artificial Sequence
  Synthetic Polynucleotide
taatacgactcactatagggctgttcttgctgcccgtcttggggccgtgcaacagaggagagcacggatgcaagacgggaacctggcggcagcgcaaaagatg

SEQ ID NO: 239844 - DNA, 103 bp, Artificial Sequence
  Synthetic Polynucleotide
taatacgactcactatagggactcttgggcctgttcttgctgcccgtcttaacagaggagaaagacgatgagcaagaacaacctggcggcagcgcaaaagatg

SEQ ID NO: 239845 - DNA, 103 bp, Artificial Sequence
  Synthetic Polynucleotide
taatacgactcactatagggggtccagctcactcttgggcctgttcttgcaacagaggagagcaagaatgggcccaagaaacctggcggcagcgcaaaagatg

SEQ ID NO: 239846 - DNA, 103 bp, Artificial Sequence
  Synthetic Polynucleotide
taatacgactcactataggggtggcgatggggtccagctcactcttgggcaacagaggagagcccaaatgtgagctggaaacctggcggcagcgcaaaagatg

SEQ ID NO: 239847 - DNA, 103 bp, Artificial Sequence
  Synthetic Polynucleotide
taatacgactcactataggggttgttgatggtggcgatggggtccagctcaacagaggagagagctgatgcccatcgccaacctggcggcagcgcaaaagatg

SEQ ID NO: 239848 - DNA, 103 bp, Artificial Sequence
  Synthetic Polynucleotide
taatacgactcactatagggcctggaccacgttgttgatggtggcgatggaacagaggagaccatcgatgccatcaacaaacctggcggcagcgcaaaagatg

SEQ ID NO: 239849 - DNA, 103 bp, Artificial Sequence
  Synthetic Polynucleotide
taatacgactcactatagggatcacctcctcctggaccacgttgttgatgaacagaggagacatcaaatgcgtggtccaaacctggcggcagcgcaaaagatg

SEQ ID NO: 239850 - DNA, 103 bp, Artificial Sequence
  Synthetic Polynucleotide
taatacgactcactataggggccggcgacgatcacctcctcctggaccacaacagaggagagtggtcatggaggaggtgaacctggcggcagcgcaaaagatg

SEQ ID NO: 239851 - DNA, 103 bp, Artificial Sequence
  Synthetic Polynucleotide
taatacgactcactatagggagaggctcaggccggcgacgatcacctcctaacagaggagaaggaggatgtcgtcgccgaacctggcggcagcgcaaaagatg

SEQ ID NO: 239852 - DNA, 103 bp, Artificial Sequence
  Synthetic Polynucleotide
taatacgactcactatagggcagacctcgtagaggctcaggccggcgacgaacagaggagacgtcgcatgcctgagcctaacctggcggcagcgcaaaagatg

SEQ ID NO: 239853 - DNA, 103 bp, Artificial Sequence
  Synthetic Polynucleotide
taatacgactcactatagggcactccaaggcacaggctcgcttcttccataacagaggagaatggaaatggcgagcctgaacctggcggcagcgcaaaagatg

SEQ ID NO: 239854 - DNA, 103 bp, Artificial Sequence
  Synthetic Polynucleotide
taatacgactcactatagggggtgatctggtgcagcttctgactcatggcaacagaggagagccatgatgcagaagctgaacctggcggcagcgcaaaagatg

SEQ ID NO: 239855 - DNA, 103 bp, Artificial Sequence
  Synthetic Polynucleotide
taatacgactcactatagggctgctcgccaccgccgttggggccctggccaacagaggagaggccagatgcccaacggcaacctggcggcagcgcaaaagatg

SEQ ID NO: 239856 - DNA, 103 bp, Artificial Sequence
  Synthetic Polynucleotide
taatacgactcactatagggcgttggccgactgctcgccaccgccgttggaacagaggagaccaacgatggtggcgagcaacctggcggcagcgcaaaagatg

SEQ ID NO: 239857 - DNA, 103 bp, Artificial Sequence
  Synthetic Polynucleotide
taatacgactcactatagggcagcggaactcgttggccgactgctcgccaaacagaggagatggcgaatggtcggccaaaacctggcggcagcgcaaaagatg

SEQ ID NO: 239858 - DNA, 103 bp, Artificial Sequence
  Synthetic Polynucleotide
taatacgactcactataggggcacacctcgcagcggaactcgttggccgaaacagaggagatcggccatggagttccgcaacctggcggcagcgcaaaagatg

SEQ ID NO: 239859 - DNA, 103 bp, Artificial Sequence
  Synthetic Polynucleotide
taatacgactcactatagggacacctgaccgcacacctcgcagcggaactaacagaggagaagttccatggcgaggtgtaacctggcggcagcgcaaaagatg

SEQ ID NO: 239860 - DNA, 103 bp, Artificial Sequence
  Synthetic Polynucleotide
taatacgactcactataggggcctggctgaacacctgaccgcacacctcgaacagaggagacgaggtatgcggtcaggtaacctggcggcagcgcaaaagatg

SEQ ID NO: 239861 - DNA, 103 bp, Artificial Sequence
  Synthetic Polynucleotide
taatacgactcactataggggaggaaccacgcctggctgaacacctgaccaacagaggagaggtcagatgttcagccagaacctggcggcagcgcaaaagatg

SEQ ID NO: 239862 - DNA, 103 bp, Artificial Sequence
  Synthetic Polynucleotide
taatacgactcactatagggtgtgacccttgaggaaccacgcctggctgaaacagaggagatcagccatgcgtggttccaacctggcggcagcgcaaaagatg

SEQ ID NO: 239863 - DNA, 103 bp, Artificial Sequence
  Synthetic Polynucleotide
taatacgactcactatagggtgcttgcgcatgtgacccttgaggaaccacaacagaggagagtggttatgcaagggtcaaacctggcggcagcgcaaaagatg

SEQ ID NO: 239864 - DNA, 103 bp, Artificial Sequence
  Synthetic Polynucleotide
taatacgactcactatagggggagtctttgtgcttgcgcatgtgacccttaacagaggagaaagggtatgatgcgcaagaacctggcggcagcgcaaaagatg

SEQ ID NO: 239865 - DNA, 103 bp, Artificial Sequence
  Synthetic Polynucleotide
taatacgactcactatagggtgagctgggaggtgatctggtgcagcttctaacagaggagaagaagcatgaccagatcaaacctggcggcagcgcaaaagatg

SEQ ID NO: 239866 - DNA, 103 bp, Artificial Sequence
  Synthetic Polynucleotide
taatacgactcactatagggagtgctcaaaggagtctttgtgcttgcgcaaacagaggagatgcgcaatgacaaagactaacctggcggcagcgcaaaagatg

SEQ ID NO: 239867 - DNA, 103 bp, Artificial Sequence
  Synthetic Polynucleotide
taatacgactcactatagggatctggcagcagtgctcaaaggagtctttgaacagaggagacaaagaatgctttgagcaaacctggcggcagcgcaaaagatg

SEQ ID NO: 239868 - DNA, 103 bp, Artificial Sequence
  Synthetic Polynucleotide
taatacgactcactatagggccggccgcagatctggcagcagtgctcaaaaacagaggagatttgagatgtgctgccagaacctggcggcagcgcaaaagatg

SEQ ID NO: 239869 - DNA, 103 bp, Artificial Sequence
  Synthetic Polynucleotide
taatacgactcactatagggccttgaagcgccggccgcagatctggcagcaacagaggagagctgccatgtctgcggccaacctggcggcagcgcaaaagatg

SEQ ID NO: 239870 - DNA, 103 bp, Artificial Sequence
  Synthetic Polynucleotide
taatacgactcactatagggaaccagggctccttgaagcgccggccgcagaacagaggagactgcggatggcgcttcaaaacctggcggcagcgcaaaagatg

SEQ ID NO: 239871 - DNA, 103 bp, Artificial Sequence
  Synthetic Polynucleotide
taatacgactcactataggggttcttgaggaaccagggctccttgaagcgaacagaggagacgcttcatggagccctggaacctggcggcagcgcaaaagatg

SEQ ID NO: 239872 - DNA, 103 bp, Artificial Sequence
  Synthetic Polynucleotide
taatacgactcactatagggccttcatgtggttcttgaggaaccagggctaacagaggagaagccctatgtcctcaagaaacctggcggcagcgcaaaagatg

SEQ ID NO: 239873 - DNA, 103 bp, Artificial Sequence
  Synthetic Polynucleotide
taatacgactcactatagggttgaggtggaccttcatgtggttcttgaggaacagaggagacctcaaatgccacatgaaaacctggcggcagcgcaaaagatg

SEQ ID NO: 239874 - DNA, 103 bp, Artificial Sequence
  Synthetic Polynucleotide
taatacgactcactatagggcgacagcttgttgaggtggaccttcatgtgaacagaggagacacatgatggtccacctcaacctggcggcagcgcaaaagatg

SEQ ID NO: 239875 - DNA, 103 bp, Artificial Sequence
  Synthetic Polynucleotide
taatacgactcactatagggtgttcttcaccgacagcttgttgaggtggaaacagaggagatccaccatgacaagctgtaacctggcggcagcgcaaaagatg

SEQ ID NO: 239876 - DNA, 103 bp, Artificial Sequence
  Synthetic Polynucleotide
taatacgactcactatagggaaggcatggctgagctgggaggtgatctggaacagaggagaccagatatgctcccagctaacctggcggcagcgcaaaagatg

SEQ ID NO: 239877 - DNA, 103 bp, Artificial Sequence
  Synthetic Polynucleotide
taatacgactcactatagggctgggggacttgttcttcaccgacagcttgaacagaggagacaagctatgggtgaagaaaacctggcggcagcgcaaaagatg

SEQ ID NO: 239878 - DNA, 103 bp, Artificial Sequence
  Synthetic Polynucleotide
taatacgactcactatagggctcggggtcgctgggggacttgttcttcacaacagaggagagtgaagatgaagtcccccaacctggcggcagcgcaaaagatg

SEQ ID NO: 239879 - DNA, 103 bp, Artificial Sequence
  Synthetic Polynucleotide
taatacgactcactataggggcacaggcacctcggggtcgctgggggactaacagaggagaagtcccatggcgaccccgaacctggcggcagcgcaaaagatg

SEQ ID NO: 239880 - DNA, 103 bp, Artificial Sequence
  Synthetic Polynucleotide
taatacgactcactatagggccgcccatgggcacaggcacctcggggtcgaacagaggagacgacccatgggtgcctgtaacctggcggcagcgcaaaagatg

SEQ ID NO: 239881 - DNA, 103 bp, Artificial Sequence
  Synthetic Polynucleotide
taatacgactcactatagggctgggacatgccgcccatgggcacaggcacaacagaggagagtgcctatgcccatgggcaacctggcggcagcgcaaaagatg

SEQ ID NO: 239882 - DNA, 103 bp, Artificial Sequence
  Synthetic Polynucleotide
taatacgactcactatagggcgtgggcctcctgggacatgccgcccatggaacagaggagaccatggatggcatgtcccaacctggcggcagcgcaaaagatg

SEQ ID NO: 239883 - DNA, 103 bp, Artificial Sequence
  Synthetic Polynucleotide
taatacgactcactatagggtacaggttggcgtgggcctcctgggacatgaacagaggagacatgtcatgggaggcccaaacctggcggcagcgcaaaagatg

SEQ ID NO: 239884 - DNA, 103 bp, Artificial Sequence
  Synthetic Polynucleotide
taatacgactcactataggggtacctggagtacaggttggcgtgggcctcaacagaggagagaggccatggccaacctgaacctggcggcagcgcaaaagatg

SEQ ID NO: 239885 - DNA, 103 bp, Artificial Sequence
  Synthetic Polynucleotide
taatacgactcactatagggggcaggagaggtacctggagtacaggttggaacagaggagaccaaccatgactccaggtaacctggcggcagcgcaaaagatg

SEQ ID NO: 239886 - DNA, 103 bp, Artificial Sequence
  Synthetic Polynucleotide
taatacgactcactatagggccactctgcaggcaggagaggtacctggagaacagaggagactccagatgcctctcctgaacctggcggcagcgcaaaagatg

SEQ ID NO: 239887 - DNA, 103 bp, Artificial Sequence
  Synthetic Polynucleotide
taatacgactcactataggggagctcggggaaggcatggctgagctgggaaacagaggagatcccagatgagccatgccaacctggcggcagcgcaaaagatg

SEQ ID NO: 239888 - DNA, 103 bp, Artificial Sequence
  Synthetic Polynucleotide
taatacgactcactatagggggtcatgaagccactctgcaggcaggagagaacagaggagactctccatgctgcagagtaacctggcggcagcgcaaaagatg

SEQ ID NO: 239889 - DNA, 103 bp, Artificial Sequence
  Synthetic Polynucleotide
taatacgactcactatagggctttgtccggggtcatgaagccactctgcaaacagaggagatgcagaatggcttcatgaaacctggcggcagcgcaaaagatg

SEQ ID NO: 239890 - DNA, 103 bp, Artificial Sequence
  Synthetic Polynucleotide
taatacgactcactatagggctcaggccggctttgtccggggtcatgaagaacagaggagacttcatatgcccggacaaaacctggcggcagcgcaaaagatg

SEQ ID NO: 239891 - DNA, 103 bp, Artificial Sequence
  Synthetic Polynucleotide
taatacgactcactataggggctgggctcgctcaggccggctttgtccggaacagaggagaccggacatggccggcctgaacctggcggcagcgcaaaagatg

SEQ ID NO: 239892 - DNA, 103 bp, Artificial Sequence
  Synthetic Polynucleotide
taatacgactcactatagggcatagagctggctgggctcgctcaggccggaacagaggagaccggccatggcgagcccaaacctggcggcagcgcaaaagatg

SEQ ID NO: 239893 - DNA, 103 bp, Artificial Sequence
  Synthetic Polynucleotide
taatacgactcactatagggtcgcccttgccatagagctggctgggctcgaacagaggagacgagccatgccagctctaaacctggcggcagcgcaaaagatg

SEQ ID NO: 239894 - DNA, 103 bp, Artificial Sequence
  Synthetic Polynucleotide
taatacgactcactatagggcatgggcagctcgcccttgccatagagctgaacagaggagacagctcatgggcaagggcaacctggcggcagcgcaaaagatg

SEQ ID NO: 239895 - DNA, 103 bp, Artificial Sequence
  Synthetic Polynucleotide
taatacgactcactatagggccttctccttcatgggcagctcgcccttgcaacagaggagagcaaggatgagctgcccaaacctggcggcagcgcaaaagatg

SEQ ID NO: 239896 - DNA, 103 bp, Artificial Sequence
  Synthetic Polynucleotide
taatacgactcactatagggcccagcgcttccttctccttcatgggcagcaacagaggagagctgccatggaaggagaaaacctggcggcagcgcaaaagatg

SEQ ID NO: 239897 - DNA, 103 bp, Artificial Sequence
  Synthetic Polynucleotide
taatacgactcactatagggcagcagcttccccagcgcttccttctccttaacagaggagaaaggagatggaagcgctgaacctggcggcagcgcaaaagatg

SEQ ID NO: 239898 - DNA, 103 bp, Artificial Sequence
  Synthetic Polynucleotide
taatacgactcactataggggccggggatggagctcggggaaggcatggcaacagaggagagccatgatgtccccgagcaacctggcggcagcgcaaaagatg

SEQ ID NO: 239899 - DNA, 103 bp, Artificial Sequence
  Synthetic Polynucleotide
taatacgactcactatagggagatgggagacagcagcttccccagcgcttaacagaggagaaagcgcatgggaagctgcaacctggcggcagcgcaaaagatg

SEQ ID NO: 239900 - DNA, 103 bp, Artificial Sequence
  Synthetic Polynucleotide
taatacgactcactataggggccatgctggagatgggagacagcagcttcaacagaggagagaagctatggtctcccataacctggcggcagcgcaaaagatg

SEQ ID NO: 239901 - DNA, 103 bp, Artificial Sequence
  Synthetic Polynucleotide
taatacgactcactataggggacgccgtgggccatgctggagatgggagaaacagaggagatctcccatgtccagcatgaacctggcggcagcgcaaaagatg

SEQ ID NO: 239902 - DNA, 103 bp, Artificial Sequence
  Synthetic Polynucleotide
taatacgactcactatagggccccctccgggacgccgtgggccatgctggaacagaggagaccagcaatgcccacggcgaacctggcggcagcgcaaaagatg

SEQ ID NO: 239903 - DNA, 103 bp, Artificial Sequence
  Synthetic Polynucleotide
taatacgactcactataggggagtgcttgtccccctccgggacgccgtggaacagaggagaccacggatgcccggagggaacctggcggcagcgcaaaagatg

SEQ ID NO: 239904 - DNA, 103 bp, Artificial Sequence
  Synthetic Polynucleotide
taatacgactcactatagggtcccaggagggagtgcttgtccccctccggaacagaggagaccggagatggacaagcacaacctggcggcagcgcaaaagatg

SEQ ID NO: 239905 - DNA, 103 bp, Artificial Sequence
  Synthetic Polynucleotide
taatacgactcactataggggattgaggcatcccaggagggagtgcttgtaacagaggagaacaagcatgccctcctggaacctggcggcagcgcaaaagatg

SEQ ID NO: 239906 - DNA, 103 bp, Artificial Sequence
  Synthetic Polynucleotide
taatacgactcactatagggggcggcacgagattgaggcatcccaggaggaacagaggagacctcctatgatgcctcaaaacctggcggcagcgcaaaagatg

SEQ ID NO: 239907 - DNA, 103 bp, Artificial Sequence
  Synthetic Polynucleotide
taatacgactcactatagggggatttcagcggcggcacgagattgaggcaaacagaggagatgcctcatgctcgtgccgaacctggcggcagcgcaaaagatg

SEQ ID NO: 239908 - DNA, 103 bp, Artificial Sequence
  Synthetic Polynucleotide
taatacgactcactatagggcgatgcagctggatttcagcggcggcacgaaacagaggagatcgtgcatgcgctgaaataacctggcggcagcgcaaaagatg

SEQ ID NO: 239909 - DNA, 103 bp, Artificial Sequence
  Synthetic Polynucleotide
taatacgactcactatagggtcggggttgggccggggatggagctcggggaacagaggagaccccgaatgccatccccgaacctggcggcagcgcaaaagatg

SEQ ID NO: 239910 - DNA, 103 bp, Artificial Sequence
  Synthetic Polynucleotide
taatacgactcactatagggtgcagccgctcgatgcagctggatttcagcaacagaggagagctgaaatgcagctgcataacctggcggcagcgcaaaagatg

SEQ ID NO: 239911 - DNA, 103 bp, Artificial Sequence
  Synthetic Polynucleotide
taatacgactcactatagggggcagccgcctgcagccgctcgatgcagctaacagaggagaagctgcatggagcggctgaacctggcggcagcgcaaaagatg

SEQ ID NO: 239912 - DNA, 103 bp, Artificial Sequence
  Synthetic Polynucleotide
taatacgactcactatagggccgcagccttggcagccgcctgcagccgctaacagaggagaagcggcatgaggcggctgaacctggcggcagcgcaaaagatg

SEQ ID NO: 239913 - DNA, 103 bp, Artificial Sequence
  Synthetic Polynucleotide
taatacgactcactataggggggtccatctccgcagccttggcagccgccaacagaggagaggcggcatgcaaggctgcaacctggcggcagcgcaaaagatg

SEQ ID NO: 239914 - DNA, 103 bp, Artificial Sequence
  Synthetic Polynucleotide
taatacgactcactataggggctgttcacggggtccatctccgcagccttaacagaggagaaaggctatggagatggacaacctggcggcagcgcaaaagatg

SEQ ID NO: 239915 - DNA, 103 bp, Artificial Sequence
  Synthetic Polynucleotide
taatacgactcactatagggaagcctggtagctgttcacggggtccatctaacagaggagaagatggatgccgtgaacaaacctggcggcagcgcaaaagatg

SEQ ID NO: 239916 - DNA, 103 bp, Artificial Sequence
  Synthetic Polynucleotide
taatacgactcactatagggatgagctgccaagcctggtagctgttcacgaacagaggagacgtgaaatgctaccaggcaacctggcggcagcgcaaaagatg

SEQ ID NO: 239917 - DNA, 103 bp, Artificial Sequence
  Synthetic Polynucleotide
taatacgactcactataggggcccctggccatgagctgccaagcctggtaaacagaggagataccagatgtggcagctcaacctggcggcagcgcaaaagatg

SEQ ID NO: 239918 - DNA, 103 bp, Artificial Sequence
  Synthetic Polynucleotide
taatacgactcactatagggccatggccatgcccctggccatgagctgccaacagaggagaggcagcatgtggccagggaacctggcggcagcgcaaaagatg

SEQ ID NO: 239919 - DNA, 103 bp, Artificial Sequence
  Synthetic Polynucleotide
taatacgactcactatagggaagccatgttccatggccatgcccctggccaacagaggagaggccagatgcatggccataacctggcggcagcgcaaaagatg

SEQ ID NO: 239920 - DNA, 103 bp, Artificial Sequence
  Synthetic Polynucleotide
taatacgactcactataggggggcttctcctcggggttgggccggggatgaacagaggagacatcccatgcccaaccccaacctggcggcagcgcaaaagatg

SEQ ID NO: 239921 - DNA, 103 bp, Artificial Sequence
  Synthetic Polynucleotide
taatacgactcactatagggtttagacaagaagccatgttccatggccataacagaggagaatggccatggaacatggcaacctggcggcagcgcaaaagatg

SEQ ID NO: 239922 - DNA, 103 bp, Artificial Sequence
  Synthetic Polynucleotide
taatacgactcactataggggcggatgctctttagacaagaagccatgttaacagaggagaaacatgatgtcttgtctaaacctggcggcagcgcaaaagatg

SEQ ID NO: 239923 - DNA, 103 bp, Artificial Sequence
  Synthetic Polynucleotide
taatacgactcactatagggttgcgctgcagcggatgctctttagacaagaacagaggagacttgtcatgagagcatccaacctggcggcagcgcaaaagatg

SEQ ID NO: 239924 - DNA, 103 bp, Artificial Sequence
  Synthetic Polynucleotide
taatacgactcactataggggtcttcgtggttgcgctgcagcggatgctcaacagaggagagagcatatgctgcagcgcaacctggcggcagcgcaaaagatg

SEQ ID NO: 239925 - DNA, 103 bp, Artificial Sequence
  Synthetic Polynucleotide
taatacgactcactatagggttgccaaagtgtcttcgtggttgcgctgcaaacagaggagatgcagcatgaccacgaagaacctggcggcagcgcaaaagatg

SEQ ID NO: 239926 - DNA, 103 bp, Artificial Sequence
  Synthetic Polynucleotide
taatacgactcactatagggaccccggcgtttgccaaagtgtcttcgtggaacagaggagaccacgaatgcactttggcaacctggcggcagcgcaaaagatg

SEQ ID NO: 239927 - DNA, 103 bp, Artificial Sequence
  Synthetic Polynucleotide
taatacgactcactatagggatcaaacagaaccccggcgtttgccaaagtaacagaggagaactttgatgaacgccgggaacctggcggcagcgcaaaagatg

SEQ ID NO: 239928 - DNA, 103 bp, Artificial Sequence
  Synthetic Polynucleotide
taatacgactcactataggggcttctccttatcaaacagaaccccggcgtaacagaggagaacgccgatgttctgtttgaacctggcggcagcgcaaaagatg

SEQ ID NO: 239929 - DNA, 103 bp, Artificial Sequence
  Synthetic Polynucleotide
taatacgactcactatagggacgtactcccgcttctccttatcaaacagaaacagaggagatctgttatgtaaggagaaaacctggcggcagcgcaaaagatg

SEQ ID NO: 239930 - DNA, 103 bp, Artificial Sequence
  Synthetic Polynucleotide
taatacgactcactatagggtcccactaacacgtactcccgcttctccttaacagaggagaaaggagatgcgggagtacaacctggcggcagcgcaaaagatg

SEQ ID NO: 239931 - DNA, 103 bp, Artificial Sequence
  Synthetic Polynucleotide
taatacgactcactataggggggatgcggggggcttctcctcggggttggaacagaggagaccaaccatgaggagaagcaacctggcggcagcgcaaaagatg

SEQ ID NO: 239932 - DNA, 103 bp, Artificial Sequence
  Synthetic Polynucleotide
taatacgactcactatagggagccatctgctcccactaacacgtactcccaacagaggagagggagtatgtgttagtggaacctggcggcagcgcaaaagatg

SEQ ID NO: 239933 - DNA, 103 bp, Artificial Sequence
  Synthetic Polynucleotide
taatacgactcactatagggttctgcttggagccatctgctcccactaacaacagaggagagttagtatgagcagatggaacctggcggcagcgcaaaagatg

SEQ ID NO: 239934 - DNA, 103 bp, Artificial Sequence
  Synthetic Polynucleotide
taatacgactcactatagggagcaggcattttctgcttggagccatctgcaacagaggagagcagatatgtccaagcagaacctggcggcagcgcaaaagatg

SEQ ID NO: 239935 - DNA, 103 bp, Artificial Sequence
  Synthetic Polynucleotide
taatacgactcactataggggaaccaaatcagcaggcattttctgcttggaacagaggagaccaagcatgaaatgcctgaacctggcggcagcgcaaaagatg

SEQ ID NO: 239936 - DNA, 103 bp, Artificial Sequence
  Synthetic Polynucleotide
taatacgactcactatagggttagtgctgtgaaccaaatcagcaggcattaacagaggagaaatgccatgtgatttggtaacctggcggcagcgcaaaagatg

SEQ ID NO: 239937 - DNA, 103 bp, Artificial Sequence
  Synthetic Polynucleotide
taatacgactcactataggggctgcccactttagtgctgtgaaccaaatcaacagaggagagatttgatgcacagcactaacctggcggcagcgcaaaagatg

SEQ ID NO: 239938 - DNA, 103 bp, Artificial Sequence
  Synthetic Polynucleotide
taatacgactcactatagggggtctctctggctgcccactttagtgctgtaacagaggagaacagcaatgaagtgggcaaacctggcggcagcgcaaaagatg

SEQ ID NO: 239939 - DNA, 103 bp, Artificial Sequence
  Synthetic Polynucleotide
taatacgactcactatagggttacttggcaggtctctctggctgcccactaacagaggagaagtgggatgccagagagaaacctggcggcagcgcaaaagatg

SEQ ID NO: 239940 - DNA, 103 bp, Artificial Sequence
  Synthetic Polynucleotide
taatacgactcactatagggagggtcgagcttacttggcaggtctctctgaacagaggagacagagaatgctgccaagtaacctggcggcagcgcaaaagatg

SEQ ID NO: 239941 - DNA, 103 bp, Artificial Sequence
  Synthetic Polynucleotide
taatacgactcactatagggtgctttctaaagggtcgagcttacttggcaaacagaggagatgccaaatgagctcgaccaacctggcggcagcgcaaaagatg

SEQ ID NO: 239942 - DNA, 103 bp, Artificial Sequence
  Synthetic Polynucleotide
taatacgactcactatagggttctcctccagggatgcggggggcttctccaacagaggagaggagaaatgccccgcatcaacctggcggcagcgcaaaagatg

SEQ ID NO: 239943 - DNA, 103 bp, Artificial Sequence
  Synthetic Polynucleotide
taatacgactcactatagggaaatcccgactgctttctaaagggtcgagcaacagaggagagctcgaatgtttagaaagaacctggcggcagcgcaaaagatg

SEQ ID NO: 239944 - DNA, 103 bp, Artificial Sequence
  Synthetic Polynucleotide
taatacgactcactataggggtgtgacaaaaaatcccgactgctttctaaaacagaggagattagaaatgagtcgggataacctggcggcagcgcaaaagatg

SEQ ID NO: 239945 - DNA, 103 bp, Artificial Sequence
  Synthetic Polynucleotide
taatacgactcactatagggggttcagcccgtgtgacaaaaaatcccgacaacagaggagagtcgggatgttttgtcacaacctggcggcagcgcaaaagatg

SEQ ID NO: 239946 - DNA, 103 bp, Artificial Sequence
  Synthetic Polynucleotide
taatacgactcactatagggtcgagagtctggttcagcccgtgtgacaaaaacagaggagatttgtcatgcgggctgaaaacctggcggcagcgcaaaagatg

SEQ ID NO: 239947 - DNA, 103 bp, Artificial Sequence
  Synthetic Polynucleotide
taatacgactcactatagggcaggttatactcgagagtctggttcagcccaacagaggagagggctgatgcagactctcaacctggcggcagcgcaaaagatg

SEQ ID NO: 239948 - DNA, 103 bp, Artificial Sequence
  Synthetic Polynucleotide
taatacgactcactatagggcaggaccctgcaggttatactcgagagtctaacagaggagaagactcatgagtataaccaacctggcggcagcgcaaaagatg

SEQ ID NO: 239949 - DNA, 103 bp, Artificial Sequence
  Synthetic Polynucleotide
taatacgactcactatagggttcatgttcccaggaccctgcaggttatacaacagaggagagtataaatggcagggtccaacctggcggcagcgcaaaagatg

SEQ ID NO: 239950 - DNA, 103 bp, Artificial Sequence
  Synthetic Polynucleotide
taatacgactcactataggggggcttctccttcatgttcccaggaccctgaacagaggagacagggtatggggaacatgaacctggcggcagcgcaaaagatg

SEQ ID NO: 239951 - DNA, 103 bp, Artificial Sequence
  Synthetic Polynucleotide
taatacgactcactatagggggcactcggtgggcttctccttcatgttccaacagaggagaggaacaatgaggagaagcaacctggcggcagcgcaaaagatg

SEQ ID NO: 239952 - DNA, 103 bp, Artificial Sequence
  Synthetic Polynucleotide
taatacgactcactatagggccgcagtcggggcactcggtgggcttctccaacagaggagaggagaaatgcaccgagtgaacctggcggcagcgcaaaagatg

SEQ ID NO: 239953 - DNA, 103 bp, Artificial Sequence
  Synthetic Polynucleotide
taatacgactcactatagggcacgtgggccttctcctccagggatgcgggaacagaggagacccgcaatgctggaggagaacctggcggcagcgcaaaagatg

SEQ ID NO: 239954 - DNA, 103 bp, Artificial Sequence
  Synthetic Polynucleotide
taatacgactcactataggggaacacccggccgcagtcggggcactcggtaacagaggagaaccgagatgcccgactgcaacctggcggcagcgcaaaagatg

SEQ ID NO: 239955 - DNA, 103 bp, Artificial Sequence
  Synthetic Polynucleotide
taatacgactcactatagggggtaagtgcggaacacccggccgcagtcggaacagaggagaccgactatggccgggtgtaacctggcggcagcgcaaaagatg

SEQ ID NO: 239956 - DNA, 103 bp, Artificial Sequence
  Synthetic Polynucleotide
taatacgactcactatagggaccacctggtggtaagtgcggaacacccggaacagaggagaccgggtatgccgcacttaaacctggcggcagcgcaaaagatg

SEQ ID NO: 239957 - DNA, 103 bp, Artificial Sequence
  Synthetic Polynucleotide
taatacgactcactatagggggagtgcacgaccacctggtggtaagtgcgaacagaggagacgcactatgcaccaggtgaacctggcggcagcgcaaaagatg

SEQ ID NO: 239958 - DNA, 103 bp, Artificial Sequence
  Synthetic Polynucleotide
taatacgactcactatagggtgtggacacgggagtgcacgaccacctggtaacagaggagaaccaggatgtcgtgcactaacctggcggcagcgcaaaagatg

SEQ ID NO: 239959 - DNA, 103 bp, Artificial Sequence
  Synthetic Polynucleotide
taatacgactcactatagggcggtcccgcttgtggacacgggagtgcacgaacagaggagacgtgcaatgccgtgtccaaacctggcggcagcgcaaaagatg

SEQ ID NO: 239960 - DNA, 103 bp, Artificial Sequence
  Synthetic Polynucleotide
taatacgactcactatagggctcgcccttgcggtcccgcttgtggacacgaacagaggagacgtgtcatgaagcgggacaacctggcggcagcgcaaaagatg

SEQ ID NO: 239961 - DNA, 103 bp, Artificial Sequence
  Synthetic Polynucleotide
taatacgactcactataggggcccatcctcctcgcccttgcggtcccgctaacagaggagaagcgggatggcaagggcgaacctggcggcagcgcaaaagatg

SEQ ID NO: 239962 - DNA, 103 bp, Artificial Sequence
  Synthetic Polynucleotide
taatacgactcactatagggcccacgtgcagcccatcctcctcgcccttgaacagaggagacaagggatgggaggatggaacctggcggcagcgcaaaagatg

SEQ ID NO: 239963 - DNA, 103 bp, Artificial Sequence
  Synthetic Polynucleotide
taatacgactcactatagggctcatccaggcccacgtgcagcccatcctcaacagaggagagaggatatgctgcacgtgaacctggcggcagcgcaaaagatg

SEQ ID NO: 239964 - DNA, 103 bp, Artificial Sequence
  Synthetic Polynucleotide
taatacgactcactatagggccgccgaagacactccaaggcacaggctcgaacagaggagacgagccatggccttggagaacctggcggcagcgcaaaagatg

SEQ ID NO: 239965 - DNA, 103 bp, Artificial Sequence
  Synthetic Polynucleotide
taatacgactcactatagggcgctcatgggcacgtgggccttctcctccaaacagaggagatggaggatgaggcccacgaacctggcggcagcgcaaaagatg

SEQ ID NO: 239966 - DNA, 103 bp, Artificial Sequence
  Synthetic Polynucleotide
taatacgactcactatagggagccacgccgctcatccaggcccacgtgcaaacagaggagatgcacgatggcctggatgaacctggcggcagcgcaaaagatg

SEQ ID NO: 239967 - DNA, 103 bp, Artificial Sequence
  Synthetic Polynucleotide
taatacgactcactatagggtcactgcccgagccacgccgctcatccaggaacagaggagacctggaatggcggcgtggaacctggcggcagcgcaaaagatg

SEQ ID NO: 239968 - DNA, 103 bp, Artificial Sequence
  Synthetic Polynucleotide
taatacgactcactatagggggactcctggtcactgcccgagccacgccgaacagaggagacggcgtatgtcgggcagtaacctggcggcagcgcaaaagatg

SEQ ID NO: 239969 - DNA, 103 bp, Artificial Sequence
  Synthetic Polynucleotide
taatacgactcactatagggtcaccgactgggactcctggtcactgcccgaacagaggagacgggcaatgaccaggagtaacctggcggcagcgcaaaagatg

SEQ ID NO: 239970 - DNA, 103 bp, Artificial Sequence
  Synthetic Polynucleotide
taatacgactcactataggggtggagcggctcaccgactgggactcctggaacagaggagaccaggaatgccagtcggtaacctggcggcagcgcaaaagatg

SEQ ID NO: 239971 - DNA, 103 bp, Artificial Sequence
  Synthetic Polynucleotide
taatacgactcactataggggcccggcgtggtggagcggctcaccgactgaacagaggagacagtcgatgagccgctccaacctggcggcagcgcaaaagatg

SEQ ID NO: 239972 - DNA, 103 bp, Artificial Sequence
  Synthetic Polynucleotide
taatacgactcactatagggcgttagaggagcccggcgtggtggagcggcaacagaggagagccgctatgccacgccggaacctggcggcagcgcaaaagatg

SEQ ID NO: 239973 - DNA, 103 bp, Artificial Sequence
  Synthetic Polynucleotide
taatacgactcactatagggtcctcggtgacgttagaggagcccggcgtgaacagaggagacacgccatgctcctctaaaacctggcggcagcgcaaaagatg

SEQ ID NO: 239974 - DNA, 103 bp, Artificial Sequence
  Synthetic Polynucleotide
taatacgactcactataggggaccccgctctcctcggtgacgttagaggaaacagaggagatcctctatggtcaccgagaacctggcggcagcgcaaaagatg

SEQ ID NO: 239975 - DNA, 103 bp, Artificial Sequence
  Synthetic Polynucleotide
taatacgactcactatagggggccgcctccgaccccgctctcctcggtgaaacagaggagatcaccgatgagagcggggaacctggcggcagcgcaaaagatg

SEQ ID NO: 239976 - DNA, 103 bp, Artificial Sequence
  Synthetic Polynucleotide
taatacgactcactatagggatgggctggccgctcatgggcacgtgggccaacagaggagaggcccaatggcccatgagaacctggcggcagcgcaaaagatg

SEQ ID NO: 239977 - DNA, 103 bp, Artificial Sequence
  Synthetic Polynucleotide
taatacgactcactataggggtctgggagaggccgcctccgaccccgctcaacagaggagagagcggatgcggaggcggaacctggcggcagcgcaaaagatg

SEQ ID NO: 239978 - DNA, 103 bp, Artificial Sequence
  Synthetic Polynucleotide
taatacgactcactatagggggcactcccggtctgggagaggccgcctccaacagaggagaggaggcatgctctcccagaacctggcggcagcgcaaaagatg

SEQ ID NO: 239979 - DNA, 103 bp, Artificial Sequence
  Synthetic Polynucleotide
taatacgactcactatagggtgtcctcctgggcactcccggtctgggagaaacagaggagatctcccatgccgggagtgaacctggcggcagcgcaaaagatg

SEQ ID NO: 239980 - DNA, 103 bp, Artificial Sequence
  Synthetic Polynucleotide
taatacgactcactataggggggtgcgggctgtcctcctgggcactcccgaacagaggagacgggagatgccaggaggaaacctggcggcagcgcaaaagatg

SEQ ID NO: 239981 - DNA, 103 bp, Artificial Sequence
  Synthetic Polynucleotide
taatacgactcactatagggtggcgaggaggggtgcgggctgtcctcctgaacagaggagacaggagatgagcccgcacaacctggcggcagcgcaaaagatg

SEQ ID NO: 239982 - DNA, 103 bp, Artificial Sequence
  Synthetic Polynucleotide
taatacgactcactatagggctgaggaggatggcgaggaggggtgcgggcaacagaggagagcccgcatgcctcctcgcaacctggcggcagcgcaaaagatg

SEQ ID NO: 239983 - DNA, 103 bp, Artificial Sequence
  Synthetic Polynucleotide
taatacgactcactatagggtcgccaatgtctgaggaggatggcgaggagaacagaggagactcctcatgatcctcctcaacctggcggcagcgcaaaagatg

SEQ ID NO: 239984 - DNA, 103 bp, Artificial Sequence
  Synthetic Polynucleotide
taatacgactcactatagggcccagcctcctcgccaatgtctgaggaggaaacagaggagatcctccatggacattggcaacctggcggcagcgcaaaagatg

SEQ ID NO: 239985 - DNA, 103 bp, Artificial Sequence
  Synthetic Polynucleotide
taatacgactcactatagggcggcagatctcccagcctcctcgccaatgtaacagaggagaacattgatgaggaggctgaacctggcggcagcgcaaaagatg

SEQ ID NO: 239986 - DNA, 103 bp, Artificial Sequence
  Synthetic Polynucleotide
taatacgactcactatagggtgctggacgccggcagatctcccagcctccaacagaggagaggaggcatggagatctgcaacctggcggcagcgcaaaagatg

SEQ ID NO: 239987 - DNA, 103 bp, Artificial Sequence
  Synthetic Polynucleotide
taatacgactcactatagggctgactgcccatgggctggccgctcatgggaacagaggagacccatgatgggccagcccaacctggcggcagcgcaaaagatg

SEQ ID NO: 239988 - DNA, 103 bp, Artificial Sequence
  Synthetic Polynucleotide
taatacgactcactatagggcagcgctggttgctggacgccggcagatctaacagaggagaagatctatgggcgtccagaacctggcggcagcgcaaaagatg

SEQ ID NO: 239989 - DNA, 103 bp, Artificial Sequence
  Synthetic Polynucleotide
taatacgactcactatagggtgtcgcgaagcagcgctggttgctggacgcaacagaggagagcgtccatgaaccagcgcaacctggcggcagcgcaaaagatg

SEQ ID NO: 239990 - DNA, 103 bp, Artificial Sequence
  Synthetic Polynucleotide
taatacgactcactatagggcccaggcttctgtcgcgaagcagcgctggtaacagaggagaaccagcatggcttcgcgaaacctggcggcagcgcaaaagatg

SEQ ID NO: 239991 - DNA, 103 bp, Artificial Sequence
  Synthetic Polynucleotide
taatacgactcactatagggcatggccgagcccaggcttctgtcgcgaagaacagaggagacttcgcatgagaagcctgaacctggcggcagcgcaaaagatg

SEQ ID NO: 239992 - DNA, 103 bp, Artificial Sequence
  Synthetic Polynucleotide
taatacgactcactatagggggcagtccttcatggccgagcccaggcttcaacagaggagagaagccatggctcggccaaacctggcggcagcgcaaaagatg

SEQ ID NO: 239993 - DNA, 103 bp, Artificial Sequence
  Synthetic Polynucleotide
taatacgactcactatagggccacagtacgggcagtccttcatggccgagaacagaggagactcggcatggaaggactgaacctggcggcagcgcaaaagatg

SEQ ID NO: 239994 - DNA, 103 bp, Artificial Sequence
  Synthetic Polynucleotide
taatacgactcactataggggaaagttttcccacagtacgggcagtccttaacagaggagaaaggacatgccgtactgtaacctggcggcagcgcaaaagatg

SEQ ID NO: 239995 - DNA, 103 bp, Artificial Sequence
  Synthetic Polynucleotide
taatacgactcactataggggggatgtccggaaagttttcccacagtacgaacagaggagacgtactatgggaaaacttaacctggcggcagcgcaaaagatg

SEQ ID NO: 239996 - DNA, 103 bp, Artificial Sequence
  Synthetic Polynucleotide
taatacgactcactatagggttaaggtgatgggatgtccggaaagttttcaacagaggagagaaaacatgccggacatcaacctggcggcagcgcaaaagatg

SEQ ID NO: 239997 - DNA, 103 bp, Artificial Sequence
  Synthetic Polynucleotide
taatacgactcactatagggcaggtgcaccttaaggtgatgggatgtccgaacagaggagacggacaatgcatcaccttaacctggcggcagcgcaaaagatg

SEQ ID NO: 239998 - DNA, 103 bp, Artificial Sequence
  Synthetic Polynucleotide
taatacgactcactatagggggagcgccatctgactgcccatgggctggcaacagaggagagccagcatgtgggcagtcaacctggcggcagcgcaaaagatg

SEQ ID NO: 239999 - DNA, 103 bp, Artificial Sequence
  Synthetic Polynucleotide
taatacgactcactatagggtgtgtatcctcaggtgcaccttaaggtgataacagaggagaatcaccatgaggtgcaccaacctggcggcagcgcaaaagatg

SEQ ID NO: 240000 - DNA, 103 bp, Artificial Sequence
  Synthetic Polynucleotide
taatacgactcactatagggttctcacctgtgtgtatcctcaggtgcaccaacagaggagaggtgcaatggaggatacaaacctggcggcagcgcaaaagatg

SEQ ID NO: 240001 - DNA, 103 bp, Artificial Sequence
  Synthetic Polynucleotide
taatacgactcactatagggcttgtagggtttctcacctgtgtgtatcctaacagaggagaaggataatgacaggtgagaacctggcggcagcgcaaaagatg

SEQ ID NO: 240002 - DNA, 103 bp, Artificial Sequence
  Synthetic Polynucleotide
taatacgactcactatagggagtgcggacacttgtagggtttctcacctgaacagaggagacaggtgatgaaccctacaaacctggcggcagcgcaaaagatg

SEQ ID NO: 240003 - DNA, 103 bp, Artificial Sequence
  Synthetic Polynucleotide
taatacgactcactataggggcatagtcacagtgcggacacttgtagggtaacagaggagaaccctaatggtgtccgcaaacctggcggcagcgcaaaagatg

SEQ ID NO: 240004 - DNA, 103 bp, Artificial Sequence
  Synthetic Polynucleotide
taatacgactcactatagggctgcgtgccggcatagtcacagtgcggacaaacagaggagatgtccgatgtgtgactataacctggcggcagcgcaaaagatg

SEQ ID NO: 240005 - DNA, 103 bp, Artificial Sequence
  Synthetic Polynucleotide
taatacgactcactatagggaggatgctgactgcgtgccggcatagtcacaacagaggagagtgactatgccggcacgcaacctggcggcagcgcaaaagatg

SEQ ID NO: 240006 - DNA, 103 bp, Artificial Sequence
  Synthetic Polynucleotide
taatacgactcactatagggtggtattttaaggatgctgactgcgtgccgaacagaggagacggcacatggtcagcatcaacctggcggcagcgcaaaagatg

SEQ ID NO: 240007 - DNA, 103 bp, Artificial Sequence
  Synthetic Polynucleotide
taatacgactcactatagggtcgctctaagtggtattttaaggatgctgaaacagaggagatcagcaatgttaaaatacaacctggcggcagcgcaaaagatg

SEQ ID NO: 240008 - DNA, 103 bp, Artificial Sequence
  Synthetic Polynucleotide
taatacgactcactatagggcccgatggtgtcgctctaagtggtattttaaacagaggagataaaatatgacttagagcaacctggcggcagcgcaaaagatg

SEQ ID NO: 240009 - DNA, 103 bp, Artificial Sequence
  Synthetic Polynucleotide
taatacgactcactatagggtggttggccaggagcgccatctgactgcccaacagaggagagggcagatggatggcgctaacctggcggcagcgcaaaagatg

SEQ ID NO: 240010 - DNA, 103 bp, Artificial Sequence
  Synthetic Polynucleotide
taatacgactcactatagggttctgccgctcccgatggtgtcgctctaagaacagaggagacttagaatgacaccatcgaacctggcggcagcgcaaaagatg

SEQ ID NO: 240011 - DNA, 103 bp, Artificial Sequence
  Synthetic Polynucleotide
taatacgactcactatagggcccagccccgttctgccgctcccgatggtgaacagaggagacaccatatggagcggcagaacctggcggcagcgcaaaagatg

SEQ ID NO: 240012 - DNA, 103 bp, Artificial Sequence
  Synthetic Polynucleotide
taatacgactcactatagggcagacagcggcccagccccgttctgccgctaacagaggagaagcggcatgacggggctgaacctggcggcagcgcaaaagatg

SEQ ID NO: 240013 - DNA, 103 bp, Artificial Sequence
  Synthetic Polynucleotide
taatacgactcactataggggggggttgcccagacagcggcccagccccgaacagaggagacggggcatggccgctgtcaacctggcggcagcgcaaaagatg

SEQ ID NO: 240014 - DNA, 103 bp, Artificial Sequence
  Synthetic Polynucleotide
taatacgactcactataggggtcttgatttgggggttgcccagacagcggaacagaggagaccgctgatggggcaacccaacctggcggcagcgcaaaagatg

SEQ ID NO: 240015 - DNA, 103 bp, Artificial Sequence
  Synthetic Polynucleotide
taatacgactcactatagggcatccttgtggtcttgatttgggggttgccaacagaggagaggcaacatgcaaatcaagaacctggcggcagcgcaaaagatg

SEQ ID NO: 240016 - DNA, 103 bp, Artificial Sequence
  Synthetic Polynucleotide
taatacgactcactatagggcttgacatctcatccttgtggtcttgatttaacagaggagaaaatcaatgccacaaggaaacctggcggcagcgcaaaagatg

SEQ ID NO: 240017 - DNA, 103 bp, Artificial Sequence
  Synthetic Polynucleotide
taatacgactcactatagggagaagctttgcttgacatctcatccttgtgaacagaggagacacaagatggagatgtcaaacctggcggcagcgcaaaagatg

SEQ ID NO: 240018 - DNA, 103 bp, Artificial Sequence
  Synthetic Polynucleotide
taatacgactcactatagggtgatgaacagagaagctttgcttgacatctaacagaggagaagatgtatggcaaagcttaacctggcggcagcgcaaaagatg

SEQ ID NO: 240019 - DNA, 103 bp, Artificial Sequence
  Synthetic Polynucleotide
taatacgactcactatagggatgtctggcctgatgaacagagaagctttgaacagaggagacaaagcatgtctgttcataacctggcggcagcgcaaaagatg

SEQ ID NO: 240020 - DNA, 103 bp, Artificial Sequence
  Synthetic Polynucleotide
taatacgactcactatagggccggcccagctggttggccaggagcgccataacagaggagaatggcgatgctggccaacaacctggcggcagcgcaaaagatg

SEQ ID NO: 240021 - DNA, 103 bp, Artificial Sequence
  Synthetic Polynucleotide
taatacgactcactatagggccccctcaggatgtctggcctgatgaacagaacagaggagactgttcatgaggccagacaacctggcggcagcgcaaaagatg

SEQ ID NO: 240022 - DNA, 103 bp, Artificial Sequence
  Synthetic Polynucleotide
taatacgactcactatagggccttgaaggcccccctcaggatgtctggccaacagaggagaggccagatgtcctgagggaacctggcggcagcgcaaaagatg

SEQ ID NO: 240023 - DNA, 103 bp, Artificial Sequence
  Synthetic Polynucleotide
taatacgactcactatagggccagggagacccttgaaggcccccctcaggaacagaggagacctgagatgggccttcaaaacctggcggcagcgcaaaagatg

SEQ ID NO: 240024 - DNA, 103 bp, Artificial Sequence
  Synthetic Polynucleotide
taatacgactcactataggggaagtcgattccagggagacccttgaaggcaacagaggagagccttcatgggtctccctaacctggcggcagcgcaaaagatg

SEQ ID NO: 240025 - DNA, 103 bp, Artificial Sequence
  Synthetic Polynucleotide
taatacgactcactatagggggcctcctctgaagtcgattccagggagacaacagaggagagtctccatggaatcgactaacctggcggcagcgcaaaagatg

SEQ ID NO: 240026 - DNA, 103 bp, Artificial Sequence
  Synthetic Polynucleotide
taatacgactcactatagggtgagatgcagggcctcctctgaagtcgattaacagaggagaaatcgaatgcagaggaggaacctggcggcagcgcaaaagatg

SEQ ID NO: 240027 - DNA, 103 bp, Artificial Sequence
  Synthetic Polynucleotide
taatacgactcactatagggtgtccactgctgagatgcagggcctcctctaacagaggagaagaggaatgcctgcatctaacctggcggcagcgcaaaagatg

SEQ ID NO: 240028 - DNA, 103 bp, Artificial Sequence
  Synthetic Polynucleotide
taatacgactcactataggggaacccctgatgtccactgctgagatgcagaacagaggagactgcatatgagcagtggaaacctggcggcagcgcaaaagatg

SEQ ID NO: 240029 - DNA, 103 bp, Artificial Sequence
  Synthetic Polynucleotide
taatacgactcactatagggccagaggagagaacccctgatgtccactgcaacagaggagagcagtgatgatcaggggtaacctggcggcagcgcaaaagatg

SEQ ID NO: 240030 - DNA, 103 bp, Artificial Sequence
  Synthetic Polynucleotide
taatacgactcactatagggcgagtgatctccagaggagagaacccctgaaacagaggagatcagggatgctctcctctaacctggcggcagcgcaaaagatg

SEQ ID NO: 240031 - DNA, 103 bp, Artificial Sequence
  Synthetic Polynucleotide
taatacgactcactatagggtgtccacctcccggcccagctggttggccaaacagaggagatggccaatgagctgggccaacctggcggcagcgcaaaagatg

SEQ ID NO: 240032 - DNA, 103 bp, Artificial Sequence
  Synthetic Polynucleotide
taatacgactcactatagggtggcctgccccgagtgatctccagaggagaaacagaggagatctcctatggagatcactaacctggcggcagcgcaaaagatg

SEQ ID NO: 240033 - DNA, 103 bp, Artificial Sequence
  Synthetic Polynucleotide
taatacgactcactataggggacatgcccgtggcctgccccgagtgatctaacagaggagaagatcaatgggggcaggcaacctggcggcagcgcaaaagatg

SEQ ID NO: 240034 - DNA, 103 bp, Artificial Sequence
  Synthetic Polynucleotide
taatacgactcactataggggacctccgaagacatgcccgtggcctgcccaacagaggagagggcagatgacgggcatgaacctggcggcagcgcaaaagatg

SEQ ID NO: 240035 - DNA, 103 bp, Artificial Sequence
  Synthetic Polynucleotide
taatacgactcactatagggcatctgaggggacctccgaagacatgcccgaacagaggagacgggcaatgcttcggaggaacctggcggcagcgcaaaagatg

SEQ ID NO: 240036 - DNA, 103 bp, Artificial Sequence
  Synthetic Polynucleotide
taatacgactcactatagggcctttcagagcatctgaggggacctccgaaaacagaggagattcggaatgcccctcagaaacctggcggcagcgcaaaagatg

SEQ ID NO: 240037 - DNA, 103 bp, Artificial Sequence
  Synthetic Polynucleotide
taatacgactcactatagggaaggtcagtgcctttcagagcatctgagggaacagaggagaccctcaatggctctgaaaaacctggcggcagcgcaaaagatg

SEQ ID NO: 240038 - DNA, 103 bp, Artificial Sequence
  Synthetic Polynucleotide
taatacgactcactatagggttttggaaggaaggtcagtgcctttcagagaacagaggagactctgaatggcactgaccaacctggcggcagcgcaaaagatg

SEQ ID NO: 240039 - DNA, 103 bp, Artificial Sequence
  Synthetic Polynucleotide
taatacgactcactatagggaagtgggtgcttttggaaggaaggtcagtgaacagaggagacactgaatgtccttccaaaacctggcggcagcgcaaaagatg

SEQ ID NO: 240040 - DNA, 103 bp, Artificial Sequence
  Synthetic Polynucleotide
taatacgactcactataggggatctcagagaagtgggtgcttttggaaggaacagaggagaccttccatgagcacccacaacctggcggcagcgcaaaagatg

SEQ ID NO: 240041 - DNA, 103 bp, Artificial Sequence
  Synthetic Polynucleotide
taatacgactcactatagggaagctcttccgatctcagagaagtgggtgcaacagaggagagcacccatgtctctgagaaacctggcggcagcgcaaaagatg

SEQ ID NO: 240042 - DNA, 103 bp, Artificial Sequence
  Synthetic Polynucleotide
taatacgactcactatagggttgaggctggtgtccacctcccggcccagcaacagaggagagctgggatgggaggtggaaacctggcggcagcgcaaaagatg

SEQ ID NO: 240043 - DNA, 103 bp, Artificial Sequence
  Synthetic Polynucleotide
taatacgactcactatagggatgctttgataagctcttccgatctcagagaacagaggagactctgaatgcggaagagcaacctggcggcagcgcaaaagatg

SEQ ID NO: 240044 - DNA, 103 bp, Artificial Sequence
  Synthetic Polynucleotide
taatacgactcactataggggttgctcacaatgctttgataagctcttccaacagaggagaggaagaatgtatcaaagcaacctggcggcagcgcaaaagatg

SEQ ID NO: 240045 - DNA, 103 bp, Artificial Sequence
  Synthetic Polynucleotide
taatacgactcactatagggaattcacaccgttgctcacaatgctttgataacagaggagaatcaaaatgttgtgagcaaacctggcggcagcgcaaaagatg

SEQ ID NO: 240046 - DNA, 103 bp, Artificial Sequence
  Synthetic Polynucleotide
taatacgactcactataggggacccttggaaattcacaccgttgctcacaaacagaggagatgtgagatgcggtgtgaaaacctggcggcagcgcaaaagatg

SEQ ID NO: 240047 - DNA, 103 bp, Artificial Sequence
  Synthetic Polynucleotide
taatacgactcactatagggagcttgcaaggacccttggaaattcacaccaacagaggagaggtgtgatgttccaagggaacctggcggcagcgcaaaagatg

SEQ ID NO: 240048 - DNA, 103 bp, Artificial Sequence
  Synthetic Polynucleotide
taatacgactcactatagggtgtccatgaaagcttgcaaggacccttggaaacagaggagatccaagatgccttgcaagaacctggcggcagcgcaaaagatg

SEQ ID NO: 240049 - DNA, 103 bp, Artificial Sequence
  Synthetic Polynucleotide
taatacgactcactatagggaggacaaaactgtccatgaaagcttgcaagaacagaggagacttgcaatgtttcatggaaacctggcggcagcgcaaaagatg

SEQ ID NO: 240050 - DNA, 103 bp, Artificial Sequence
  Synthetic Polynucleotide
taatacgactcactatagggcaaggaactgaggacaaaactgtccatgaaaacagaggagattcatgatgagttttgtcaacctggcggcagcgcaaaagatg

SEQ ID NO: 240051 - DNA, 103 bp, Artificial Sequence
  Synthetic Polynucleotide
taatacgactcactatagggtctccttcttcaaggaactgaggacaaaacaacagaggagagttttgatgtcagttcctaacctggcggcagcgcaaaagatg

SEQ ID NO: 240052 - DNA, 103 bp, Artificial Sequence
  Synthetic Polynucleotide
taatacgactcactatagggttcatgtccttctccttcttcaaggaactgaacagaggagacagttcatggaagaaggaaacctggcggcagcgcaaaagatg

SEQ ID NO: 240053 - DNA, 103 bp, Artificial Sequence
  Synthetic Polynucleotide
taatacgactcactatagggcaccctcccgttgaggctggtgtccacctcaacagaggagagaggtgatgaccagcctcaacctggcggcagcgcaaaagatg

SEQ ID NO: 240054 - DNA, 103 bp, Artificial Sequence
  Synthetic Polynucleotide
taatacgactcactatagggggctttgtccttcatgtccttctccttcttaacagaggagaaagaagatgaaggacatgaacctggcggcagcgcaaaagatg

SEQ ID NO: 240055 - DNA, 103 bp, Artificial Sequence
  Synthetic Polynucleotide
taatacgactcactatagggggtcagccagggctttgtccttcatgtcctaacagaggagaaggacaatgaggacaaagaacctggcggcagcgcaaaagatg

SEQ ID NO: 240056 - DNA, 103 bp, Artificial Sequence
  Synthetic Polynucleotide
taatacgactcactatagggatggaaggggggtcagccagggctttgtccaacagaggagaggacaaatgcctggctgaaacctggcggcagcgcaaaagatg

SEQ ID NO: 240057 - DNA, 103 bp, Artificial Sequence
  Synthetic Polynucleotide
taatacgactcactataggggtggactttcatggaaggggggtcagccagaacagaggagactggctatgcccccttccaacctggcggcagcgcaaaagatg

SEQ ID NO: 240058 - DNA, 103 bp, Artificial Sequence
  Synthetic Polynucleotide
taatacgactcactatagggcatccactccgtggactttcatggaaggggaacagaggagaccccttatgtgaaagtccaacctggcggcagcgcaaaagatg

SEQ ID NO: 240059 - DNA, 103 bp, Artificial Sequence
  Synthetic Polynucleotide
taatacgactcactatagggtcctcaccaccatccactccgtggactttcaacagaggagagaaagtatgcggagtggaaacctggcggcagcgcaaaagatg

SEQ ID NO: 240060 - DNA, 103 bp, Artificial Sequence
  Synthetic Polynucleotide
taatacgactcactatagggactgggtttctcctcaccaccatccactccaacagaggagaggagtgatgggtggtgagaacctggcggcagcgcaaaagatg

SEQ ID NO: 240061 - DNA, 103 bp, Artificial Sequence
  Synthetic Polynucleotide
taatacgactcactatagggaggacttgccactgggtttctcctcaccacaacagaggagagtggtgatgagaaacccaaacctggcggcagcgcaaaagatg

SEQ ID NO: 240062 - DNA, 103 bp, Artificial Sequence
  Synthetic Polynucleotide
taatacgactcactatagggttcctctgggaggacttgccactgggtttcaacagaggagagaaaccatgtggcaagtcaacctggcggcagcgcaaaagatg

SEQ ID NO: 240063 - DNA, 103 bp, Artificial Sequence
  Synthetic Polynucleotide
taatacgactcactatagggtttctcggacttcctctgggaggacttgccaacagaggagaggcaagatgtcccagaggaacctggcggcagcgcaaaagatg

SEQ ID NO: 240064 - DNA, 103 bp, Artificial Sequence
  Synthetic Polynucleotide
taatacgactcactataggggctgcaagtccaccctcccgttgaggctggaacagaggagaccagccatgacgggagggaacctggcggcagcgcaaaagatg

SEQ ID NO: 240065 - DNA, 103 bp, Artificial Sequence
  Synthetic Polynucleotide
taatacgactcactatagggcatactgagatttctcggacttcctctgggaacagaggagacccagaatgagtccgagaaacctggcggcagcgcaaaagatg

SEQ ID NO: 240066 - DNA, 103 bp, Artificial Sequence
  Synthetic Polynucleotide
taatacgactcactatagggtccaggggttcatactgagatttctcggacaacagaggagagtccgaatgatctcagtaaacctggcggcagcgcaaaagatg

SEQ ID NO: 240067 - DNA, 103 bp, Artificial Sequence
  Synthetic Polynucleotide
taatacgactcactatagggcacagacaagtccaggggttcatactgagaaacagaggagatctcagatggaacccctgaacctggcggcagcgcaaaagatg

SEQ ID NO: 240068 - DNA, 103 bp, Artificial Sequence
  Synthetic Polynucleotide
taatacgactcactatagggcatctggccgcacagacaagtccaggggttaacagaggagaaaccccatgacttgtctgaacctggcggcagcgcaaaagatg

SEQ ID NO: 240069 - DNA, 103 bp, Artificial Sequence
  Synthetic Polynucleotide
taatacgactcactatagggagggaggcggcatctggccgcacagacaagaacagaggagacttgtcatggcggccagaaacctggcggcagcgcaaaagatg

SEQ ID NO: 240070 - DNA, 103 bp, Artificial Sequence
  Synthetic Polynucleotide
taatacgactcactatagggggagcccgggagggaggcggcatctggccgaacagaggagacggccaatggccgcctccaacctggcggcagcgcaaaagatg

SEQ ID NO: 240071 - DNA, 103 bp, Artificial Sequence
  Synthetic Polynucleotide
taatacgactcactatagggcagttaccgaggagcccgggagggaggcggaacagaggagaccgcctatgtcccgggctaacctggcggcagcgcaaaagatg

SEQ ID NO: 240072 - DNA, 103 bp, Artificial Sequence
  Synthetic Polynucleotide
taatacgactcactatagggctgtcctgcacagttaccgaggagcccgggaacagaggagacccgggatgctcggtaacaacctggcggcagcgcaaaagatg

SEQ ID NO: 240073 - DNA, 103 bp, Artificial Sequence
  Synthetic Polynucleotide
taatacgactcactatagggccatgcaatgctgtcctgcacagttaccgaaacagaggagatcggtaatggtgcaggacaacctggcggcagcgcaaaagatg

SEQ ID NO: 240074 - DNA, 103 bp, Artificial Sequence
  Synthetic Polynucleotide
taatacgactcactatagggagcagccgtgccatgcaatgctgtcctgcaaacagaggagatgcaggatggcattgcataacctggcggcagcgcaaaagatg

SEQ ID NO: 240075 - DNA, 103 bp, Artificial Sequence
  Synthetic Polynucleotide
taatacgactcactataggggcttccggctccgccgaagacactccaaggaacagaggagaccttggatggtcttcggcaacctggcggcagcgcaaaagatg

SEQ ID NO: 240076 - DNA, 103 bp, Artificial Sequence
  Synthetic Polynucleotide
taatacgactcactatagggttgaggaactgctgcaagtccaccctcccgaacagaggagacgggagatgggacttgcaaacctggcggcagcgcaaaagatg

SEQ ID NO: 240077 - DNA, 103 bp, Artificial Sequence
  Synthetic Polynucleotide
taatacgactcactataggggcacaaaacaagcagccgtgccatgcaatgaacagaggagacattgcatggcacggctgaacctggcggcagcgcaaaagatg

SEQ ID NO: 240078 - DNA, 103 bp, Artificial Sequence
  Synthetic Polynucleotide
taatacgactcactatagggcgttgtgaaagcacaaaacaagcagccgtgaacagaggagacacggcatgttgttttgtaacctggcggcagcgcaaaagatg

SEQ ID NO: 240079 - DNA, 103 bp, Artificial Sequence
  Synthetic Polynucleotide
taatacgactcactatagggccatggaggacgttgtgaaagcacaaaacaaacagaggagatgttttatgctttcacaaaacctggcggcagcgcaaaagatg

SEQ ID NO: 240080 - DNA, 103 bp, Artificial Sequence
  Synthetic Polynucleotide
taatacgactcactataggggccatgagctccatggaggacgttgtgaaaaacagaggagatttcacatggtcctccataacctggcggcagcgcaaaagatg

SEQ ID NO: 240081 - DNA, 103 bp, Artificial Sequence
  Synthetic Polynucleotide
taatacgactcactataggggagatgaagggccatgagctccatggaggaaacagaggagatcctccatggagctcatgaacctggcggcagcgcaaaagatg

SEQ ID NO: 240082 - DNA, 103 bp, Artificial Sequence
  Synthetic Polynucleotide
taatacgactcactatagggggttggcctggagatgaagggccatgagctaacagaggagaagctcaatgcccttcatcaacctggcggcagcgcaaaagatg

SEQ ID NO: 240083 - DNA, 103 bp, Artificial Sequence
  Synthetic Polynucleotide
taatacgactcactatagggttgcccaggtggttggcctggagatgaaggaacagaggagaccttcaatgccaggccaaaacctggcggcagcgcaaaagatg

SEQ ID NO: 240084 - DNA, 103 bp, Artificial Sequence
  Synthetic Polynucleotide
taatacgactcactataggggcgtttcgctttgcccaggtggttggcctgaacagaggagacaggccatgcacctgggcaacctggcggcagcgcaaaagatg

SEQ ID NO: 240085 - DNA, 103 bp, Artificial Sequence
  Synthetic Polynucleotide
taatacgactcactatagggtgttatctttgcgtttcgctttgcccaggtaacagaggagaacctggatgaagcgaaacaacctggcggcagcgcaaaagatg

SEQ ID NO: 240086 - DNA, 103 bp, Artificial Sequence
  Synthetic Polynucleotide
taatacgactcactatagggaccccgatggtgttatctttgcgtttcgctaacagaggagaagcgaaatgcaaagataaaacctggcggcagcgcaaaagatg

SEQ ID NO: 240087 - DNA, 103 bp, Artificial Sequence
  Synthetic Polynucleotide
taatacgactcactataggggttctgcccgttgaggaactgctgcaagtcaacagaggagagacttgatgcagttcctcaacctggcggcagcgcaaaagatg

SEQ ID NO: 240088 - DNA, 103 bp, Artificial Sequence
  Synthetic Polynucleotide
taatacgactcactataggggttgactgtgaccccgatggtgttatctttaacagaggagaaaagatatgaccatcgggaacctggcggcagcgcaaaagatg

SEQ ID NO: 240089 - DNA, 103 bp, Artificial Sequence
  Synthetic Polynucleotide
taatacgactcactatagggggtctttgcagttgactgtgaccccgatggaacagaggagaccatcgatgtcacagtcaaacctggcggcagcgcaaaagatg

SEQ ID NO: 240090 - DNA, 103 bp, Artificial Sequence
  Synthetic Polynucleotide
taatacgactcactatagggtcccgggcttggtctttgcagttgactgtgaacagaggagacacagtatgctgcaaagaaacctggcggcagcgcaaaagatg

SEQ ID NO: 240091 - DNA, 103 bp, Artificial Sequence
  Synthetic Polynucleotide
taatacgactcactatagggcttactcgcctcccgggcttggtctttgcaaacagaggagatgcaaaatgcaagcccggaacctggcggcagcgcaaaagatg

SEQ ID NO: 240092 - DNA, 103 bp, Artificial Sequence
  Synthetic Polynucleotide
taatacgactcactataggggcagggccatcttactcgcctcccgggcttaacagaggagaaagcccatgaggcgagtaaacctggcggcagcgcaaaagatg

SEQ ID NO: 240093 - DNA, 103 bp, Artificial Sequence
  Synthetic Polynucleotide
taatacgactcactatagggaacgagggcagcagggccatcttactcgccaacagaggagaggcgagatggatggccctaacctggcggcagcgcaaaagatg

SEQ ID NO: 240094 - DNA, 103 bp, Artificial Sequence
  Synthetic Polynucleotide
taatacgactcactataggggtttgattgtaacgagggcagcagggccataacagaggagaatggccatgctgccctcgaacctggcggcagcgcaaaagatg

SEQ ID NO: 240095 - DNA, 103 bp, Artificial Sequence
  Synthetic Polynucleotide
taatacgactcactatagggccaggtctttgtttgattgtaacgagggcaaacagaggagatgccctatgtacaatcaaaacctggcggcagcgcaaaagatg

SEQ ID NO: 240096 - DNA, 103 bp, Artificial Sequence
  Synthetic Polynucleotide
taatacgactcactatagggttggagaggcccaggtctttgtttgattgtaacagaggagaacaatcatgcaaagacctaacctggcggcagcgcaaaagatg

SEQ ID NO: 240097 - DNA, 103 bp, Artificial Sequence
  Synthetic Polynucleotide
taatacgactcactataggggctgatcatattggagaggcccaggtctttaacagaggagaaaagacatgggcctctccaacctggcggcagcgcaaaagatg

SEQ ID NO: 240098 - DNA, 103 bp, Artificial Sequence
  Synthetic Polynucleotide
taatacgactcactatagggtgatgcccaggttctgcccgttgaggaactaacagaggagaagttccatgacgggcagaaacctggcggcagcgcaaaagatg

SEQ ID NO: 240099 - DNA, 103 bp, Artificial Sequence
  Synthetic Polynucleotide
taatacgactcactatagggagtctagagagctgatcatattggagaggcaacagaggagagcctctatgatatgatcaaacctggcggcagcgcaaaagatg

SEQ ID NO: 240100 - DNA, 103 bp, Artificial Sequence
  Synthetic Polynucleotide
taatacgactcactatagggtcagaagcagagtctagagagctgatcataaacagaggagatatgatatgctctctagaaacctggcggcagcgcaaaagatg

SEQ ID NO: 240101 - DNA, 103 bp, Artificial Sequence
  Synthetic Polynucleotide
taatacgactcactatagggggccatcttctcagaagcagagtctagagaaacagaggagatctctaatgtctgcttctaacctggcggcagcgcaaaagatg

SEQ ID NO: 240102 - DNA, 103 bp, Artificial Sequence
  Synthetic Polynucleotide
taatacgactcactataggggctgaccttgggccatcttctcagaagcagaacagaggagactgcttatgagaagatggaacctggcggcagcgcaaaagatg

SEQ ID NO: 240103 - DNA, 103 bp, Artificial Sequence
  Synthetic Polynucleotide
taatacgactcactataggggtctccttgagctgaccttgggccatcttcaacagaggagagaagatatgccaaggtcaaacctggcggcagcgcaaaagatg

SEQ ID NO: 240104 - DNA, 103 bp, Artificial Sequence
  Synthetic Polynucleotide
taatacgactcactatagggctctcccagagtctccttgagctgaccttgaacagaggagacaaggtatgctcaaggagaacctggcggcagcgcaaaagatg

SEQ ID NO: 240105 - DNA, 103 bp, Artificial Sequence
  Synthetic Polynucleotide
taatacgactcactatagggcgctcttctgctctcccagagtctccttgaaacagaggagatcaaggatgctctgggagaacctggcggcagcgcaaaagatg

SEQ ID NO: 240106 - DNA, 103 bp, Artificial Sequence
  Synthetic Polynucleotide
taatacgactcactataggggtccatgcaccgctcttctgctctcccagaaacagaggagatctgggatggcagaagagaacctggcggcagcgcaaaagatg

SEQ ID NO: 240107 - DNA, 103 bp, Artificial Sequence
  Synthetic Polynucleotide
taatacgactcactatagggcacgtggccggtccatgcaccgctcttctgaacagaggagacagaagatgggtgcatggaacctggcggcagcgcaaaagatg

SEQ ID NO: 240108 - DNA, 103 bp, Artificial Sequence
  Synthetic Polynucleotide
taatacgactcactatagggatgcagggtccacgtggccggtccatgcacaacagaggagagtgcatatgccggccacgaacctggcggcagcgcaaaagatg

SEQ ID NO: 240109 - DNA, 103 bp, Artificial Sequence
  Synthetic Polynucleotide
taatacgactcactatagggatctgggacatgatgcccaggttctgcccgaacagaggagacgggcaatgcctgggcataacctggcggcagcgcaaaagatg

SEQ ID NO: 240110 - DNA, 103 bp, Artificial Sequence
  Synthetic Polynucleotide
taatacgactcactatagggaagttacaaaatgcagggtccacgtggccgaacagaggagacggccaatgggaccctgcaacctggcggcagcgcaaaagatg

SEQ ID NO: 240111 - DNA, 103 bp, Artificial Sequence
  Synthetic Polynucleotide
taatacgactcactataggggtctgatgggaagttacaaaatgcagggtcaacagaggagagaccctatgttttgtaacaacctggcggcagcgcaaaagatg

SEQ ID NO: 240112 - DNA, 103 bp, Artificial Sequence
  Synthetic Polynucleotide
taatacgactcactataggggcttgtagaagtctgatgggaagttacaaaaacagaggagatttgtaatgtcccatcagaacctggcggcagcgcaaaagatg

SEQ ID NO: 240113 - DNA, 103 bp, Artificial Sequence
  Synthetic Polynucleotide
taatacgactcactatagggacaccaaactgcttgtagaagtctgatgggaacagaggagacccatcatgcttctacaaaacctggcggcagcgcaaaagatg

SEQ ID NO: 240114 - DNA, 103 bp, Artificial Sequence
  Synthetic Polynucleotide
taatacgactcactataggggcctgggtaaacaccaaactgcttgtagaaaacagaggagattctacatgcagtttggtaacctggcggcagcgcaaaagatg

SEQ ID NO: 240115 - DNA, 103 bp, Artificial Sequence
  Synthetic Polynucleotide
taatacgactcactatagggagccaaccatgcctgggtaaacaccaaactaacagaggagaagtttgatgtttacccagaacctggcggcagcgcaaaagatg

SEQ ID NO: 240116 - DNA, 103 bp, Artificial Sequence
  Synthetic Polynucleotide
taatacgactcactataggggaggcccctgagccaaccatgcctgggtaaaacagaggagattacccatgcatggttggaacctggcggcagcgcaaaagatg

SEQ ID NO: 240117 - DNA, 103 bp, Artificial Sequence
  Synthetic Polynucleotide
taatacgactcactataggggcaggaactggaggcccctgagccaaccataacagaggagaatggttatgtcaggggccaacctggcggcagcgcaaaagatg

SEQ ID NO: 240118 - DNA, 103 bp, Artificial Sequence
  Synthetic Polynucleotide
taatacgactcactatagggccttgttggggcaggaactggaggcccctgaacagaggagacaggggatgccagttcctaacctggcggcagcgcaaaagatg

SEQ ID NO: 240119 - DNA, 103 bp, Artificial Sequence
  Synthetic Polynucleotide
taatacgactcactatagggccatcaggctccttgttggggcaggaactgaacagaggagacagttcatgccccaacaaaacctggcggcagcgcaaaagatg

SEQ ID NO: 240120 - DNA, 103 bp, Artificial Sequence
  Synthetic Polynucleotide
taatacgactcactataggggatgtcgctcatctgggacatgatgcccagaacagaggagactgggcatgatgtcccagaacctggcggcagcgcaaaagatg

SEQ ID NO: 240121 - DNA, 103 bp, Artificial Sequence
  Synthetic Polynucleotide
taatacgactcactataggggtgggcctttccatcaggctccttgttgggaacagaggagacccaacatggagcctgataacctggcggcagcgcaaaagatg

SEQ ID NO: 240122 - DNA, 103 bp, Artificial Sequence
  Synthetic Polynucleotide
taatacgactcactatagggcctcttcagagtgggcctttccatcaggctaacagaggagaagcctgatggaaaggcccaacctggcggcagcgcaaaagatg

SEQ ID NO: 240123 - DNA, 103 bp, Artificial Sequence
  Synthetic Polynucleotide
taatacgactcactatagggatggggacatcctcttcagagtgggcctttaacagaggagaaaaggcatgctctgaagaaacctggcggcagcgcaaaagatg

SEQ ID NO: 240124 - DNA, 103 bp, Artificial Sequence
  Synthetic Polynucleotide
taatacgactcactatagggggggatcaggatggggacatcctcttcagaaacagaggagatctgaaatggatgtccccaacctggcggcagcgcaaaagatg

SEQ ID NO: 240125 - DNA, 103 bp, Artificial Sequence
  Synthetic Polynucleotide
taatacgactcactatagggtcgtggtttcggggatcaggatggggacataacagaggagaatgtccatgtcctgatccaacctggcggcagcgcaaaagatg

SEQ ID NO: 240126 - DNA, 103 bp, Artificial Sequence
  Synthetic Polynucleotide
taatacgactcactataggggtgttcttactcgtggtttcggggatcaggaacagaggagacctgatatgcgaaaccacaacctggcggcagcgcaaaagatg

SEQ ID NO: 240127 - DNA, 103 bp, Artificial Sequence
  Synthetic Polynucleotide
taatacgactcactataggggtcatcagtagtgttcttactcgtggtttcaacagaggagagaaaccatgagtaagaacaacctggcggcagcgcaaaagatg

SEQ ID NO: 240128 - DNA, 103 bp, Artificial Sequence
  Synthetic Polynucleotide
taatacgactcactatagggtgtcagagaggtcatcagtagtgttcttacaacagaggagagtaagaatgctactgatgaacctggcggcagcgcaaaagatg

SEQ ID NO: 240129 - DNA, 103 bp, Artificial Sequence
  Synthetic Polynucleotide
taatacgactcactataggggaggaggcaatgtcagagaggtcatcagtaaacagaggagatactgaatgcctctctgaaacctggcggcagcgcaaaagatg

SEQ ID NO: 240130 - DNA, 103 bp, Artificial Sequence
  Synthetic Polynucleotide
taatacgactcactatagggcatgtcctctgaggaggcaatgtcagagagaacagaggagactctctatgattgcctccaacctggcggcagcgcaaaagatg

SEQ ID NO: 240131 - DNA, 103 bp, Artificial Sequence
  Synthetic Polynucleotide
taatacgactcactatagggcgtcgtcctcgatgtcgctcatctgggacaaacagaggagatgtcccatgtgagcgacaaacctggcggcagcgcaaaagatg

SEQ ID NO: 240132 - DNA, 103 bp, Artificial Sequence
  Synthetic Polynucleotide
taatacgactcactatagggtggaggagtccatgtcctctgaggaggcaaaacagaggagattgcctatgcagaggacaaacctggcggcagcgcaaaagatg

SEQ ID NO: 240133 - DNA, 103 bp, Artificial Sequence
  Synthetic Polynucleotide
taatacgactcactatagggttctcccccttggaggagtccatgtcctctaacagaggagaagaggaatgggactcctcaacctggcggcagcgcaaaagatg

SEQ ID NO: 240134 - DNA, 103 bp, Artificial Sequence
  Synthetic Polynucleotide
taatacgactcactatagggttcatcgttgttctcccccttggaggagtcaacagaggagagactccatgaagggggagaacctggcggcagcgcaaaagatg

SEQ ID NO: 240135 - DNA, 103 bp, Artificial Sequence
  Synthetic Polynucleotide
taatacgactcactatagggcaacatcctcttcatcgttgttctccccctaacagaggagaagggggatgacaacgatgaacctggcggcagcgcaaaagatg

SEQ ID NO: 240136 - DNA, 103 bp, Artificial Sequence
  Synthetic Polynucleotide
taatacgactcactatagggggttcggtttcaacatcctcttcatcgttgaacagaggagacaacgaatgagaggatgtaacctggcggcagcgcaaaagatg

SEQ ID NO: 240137 - DNA, 103 bp, Artificial Sequence
  Synthetic Polynucleotide
taatacgactcactatagggcatcatttccggttcggtttcaacatcctcaacagaggagagaggatatggaaaccgaaaacctggcggcagcgcaaaagatg

SEQ ID NO: 240138 - DNA, 103 bp, Artificial Sequence
  Synthetic Polynucleotide
taatacgactcactataggggtggcttggtcatcatttccggttcggtttaacagaggagaaaaccgatgcggaaatgaaacctggcggcagcgcaaaagatg

SEQ ID NO: 240139 - DNA, 103 bp, Artificial Sequence
  Synthetic Polynucleotide
taatacgactcactatagggagggcagacagtggcttggtcatcatttccaacagaggagaggaaatatggaccaagccaacctggcggcagcgcaaaagatg

SEQ ID NO: 240140 - DNA, 103 bp, Artificial Sequence
  Synthetic Polynucleotide
taatacgactcactataggggtctttgctgagggcagacagtggcttggtaacagaggagaaccaagatgctgtctgccaacctggcggcagcgcaaaagatg

SEQ ID NO: 240141 - DNA, 103 bp, Artificial Sequence
  Synthetic Polynucleotide
taatacgactcactatagggcgctgctgctgtctttgctgagggcagacaaacagaggagatgtctgatgtcagcaaagaacctggcggcagcgcaaaagatg

SEQ ID NO: 240142 - DNA, 103 bp, Artificial Sequence
  Synthetic Polynucleotide
taatacgactcactatagggttcttgcgggcgtcgtcctcgatgtcgctcaacagaggagagagcgaatgcgaggacgaaacctggcggcagcgcaaaagatg

SEQ ID NO: 240143 - DNA, 103 bp, Artificial Sequence
  Synthetic Polynucleotide
taatacgactcactatagggtccccgccatcgctgctgctgtctttgctgaacagaggagacagcaaatgcagcagcagaacctggcggcagcgcaaaagatg

SEQ ID NO: 240144 - DNA, 103 bp, Artificial Sequence
  Synthetic Polynucleotide
taatacgactcactatagggctgcaggctgtccccgccatcgctgctgctaacagaggagaagcagcatggatggcgggaacctggcggcagcgcaaaagatg

SEQ ID NO: 240145 - DNA, 103 bp, Artificial Sequence
  Synthetic Polynucleotide
taatacgactcactatagggtgcctgtgggctgcaggctgtccccgccataacagaggagaatggcgatgacagcctgcaacctggcggcagcgcaaaagatg

SEQ ID NO: 240146 - DNA, 103 bp, Artificial Sequence
  Synthetic Polynucleotide
taatacgactcactatagggggctgggaggtgcctgtgggctgcaggctgaacagaggagacagcctatggcccacaggaacctggcggcagcgcaaaagatg

SEQ ID NO: 240147 - DNA, 103 bp, Artificial Sequence
  Synthetic Polynucleotide
taatacgactcactatagggtccctggacgggctgggaggtgcctgtgggaacagaggagacccacaatgacctcccagaacctggcggcagcgcaaaagatg

SEQ ID NO: 240148 - DNA, 103 bp, Artificial Sequence
  Synthetic Polynucleotide
taatacgactcactataggggtgagaccagtccctggacgggctgggaggaacagaggagacctcccatgccgtccaggaacctggcggcagcgcaaaagatg

SEQ ID NO: 240149 - DNA, 103 bp, Artificial Sequence
  Synthetic Polynucleotide
taatacgactcactatagggtgggataaaggtgagaccagtccctggacgaacagaggagacgtccaatgactggtctcaacctggcggcagcgcaaaagatg

SEQ ID NO: 240150 - DNA, 103 bp, Artificial Sequence
  Synthetic Polynucleotide
taatacgactcactatagggctccggtgcttgggataaaggtgagaccagaacagaggagactggtcatgcctttatccaacctggcggcagcgcaaaagatg

SEQ ID NO: 240151 - DNA, 103 bp, Artificial Sequence
  Synthetic Polynucleotide
taatacgactcactataggggccactgcttctccggtgcttgggataaagaacagaggagactttatatgaagcaccggaacctggcggcagcgcaaaagatg

SEQ ID NO: 240152 - DNA, 103 bp, Artificial Sequence
  Synthetic Polynucleotide
taatacgactcactatagggccctggctgtgccactgcttctccggtgctaacagaggagaagcaccatggaagcagtgaacctggcggcagcgcaaaagatg

SEQ ID NO: 240153 - DNA, 103 bp, Artificial Sequence
  Synthetic Polynucleotide
taatacgactcactataggggtacttgcggttcttgcgggcgtcgtcctcaacagaggagagaggacatggcccgcaagaacctggcggcagcgcaaaagatg

SEQ ID NO: 240154 - DNA, 103 bp, Artificial Sequence
  Synthetic Polynucleotide
taatacgactcactatagggttggagaagaccctggctgtgccactgcttaacagaggagaaagcagatgcacagccagaacctggcggcagcgcaaaagatg

SEQ ID NO: 240155 - DNA, 103 bp, Artificial Sequence
  Synthetic Polynucleotide
taatacgactcactatagggggtcctgggcttggagaagaccctggctgtaacagaggagaacagccatggtcttctccaacctggcggcagcgcaaaagatg

SEQ ID NO: 240156 - DNA, 103 bp, Artificial Sequence
  Synthetic Polynucleotide
taatacgactcactatagggcccgccaaggggtcctgggcttggagaagaaacagaggagatcttctatgagcccaggaaacctggcggcagcgcaaaagatg

SEQ ID NO: 240157 - DNA, 103 bp, Artificial Sequence
  Synthetic Polynucleotide
taatacgactcactatagggctttggcaggcccgccaaggggtcctgggcaacagaggagagcccagatgcccttggcgaacctggcggcagcgcaaaagatg

SEQ ID NO: 240158 - DNA, 103 bp, Artificial Sequence
  Synthetic Polynucleotide
taatacgactcactatagggcccgctccggctttggcaggcccgccaaggaacagaggagaccttggatggcctgccaaaacctggcggcagcgcaaaagatg

SEQ ID NO: 240159 - DNA, 103 bp, Artificial Sequence
  Synthetic Polynucleotide
taatacgactcactatagggctctggggcccccgctccggctttggcaggaacagaggagacctgccatggccggagcgaacctggcggcagcgcaaaagatg

SEQ ID NO: 240160 - DNA, 103 bp, Artificial Sequence
  Synthetic Polynucleotide
taatacgactcactatagggcttgtccaggctctggggcccccgctccggaacagaggagaccggagatggggccccagaacctggcggcagcgcaaaagatg

SEQ ID NO: 240161 - DNA, 103 bp, Artificial Sequence
  Synthetic Polynucleotide
taatacgactcactatagggtgttcatcggcttgtccaggctctggggccaacagaggagaggccccatggcctggacaaacctggcggcagcgcaaaagatg

SEQ ID NO: 240162 - DNA, 103 bp, Artificial Sequence
  Synthetic Polynucleotide
taatacgactcactatagggaccgacagcatgttcatcggcttgtccaggaacagaggagacctggaatggccgatgaaaacctggcggcagcgcaaaagatg

SEQ ID NO: 240163 - DNA, 103 bp, Artificial Sequence
  Synthetic Polynucleotide
taatacgactcactatagggggccctgaggaccgacagcatgttcatcggaacagaggagaccgatgatgatgctgtcgaacctggcggcagcgcaaaagatg

SEQ ID NO: 240164 - DNA, 103 bp, Artificial Sequence
  Synthetic Polynucleotide
taatacgactcactataggggtgggcacgggtacttgcggttcttgcgggaacagaggagacccgcaatgaccgcaagtaacctggcggcagcgcaaaagatg

SEQ ID NO: 240165 - DNA, 103 bp, Artificial Sequence
  Synthetic Polynucleotide
taatacgactcactatagggcagaactgtaggccctgaggaccgacagcaaacagaggagatgctgtatgtcctcagggaacctggcggcagcgcaaaagatg

SEQ ID NO: 240166 - DNA, 103 bp, Artificial Sequence
  Synthetic Polynucleotide
taatacgactcactataggggctaagccatcagaactgtaggccctgaggaacagaggagacctcagatgctacagttcaacctggcggcagcgcaaaagatg

SEQ ID NO: 240167 - DNA, 103 bp, Artificial Sequence
  Synthetic Polynucleotide
taatacgactcactataggggttaaaggctgctaagccatcagaactgtaaacagaggagatacagtatggatggcttaaacctggcggcagcgcaaaagatg

SEQ ID NO: 240168 - DNA, 103 bp, Artificial Sequence
  Synthetic Polynucleotide
taatacgactcactatagggttgcaagtccgttaaaggctgctaagccataacagaggagaatggctatgcagcctttaaacctggcggcagcgcaaaagatg

SEQ ID NO: 240169 - DNA, 103 bp, Artificial Sequence
  Synthetic Polynucleotide
taatacgactcactataggggctgtgctacttgcaagtccgttaaaggctaacagaggagaagccttatgcggacttgcaacctggcggcagcgcaaaagatg

SEQ ID NO: 240170 - DNA, 103 bp, Artificial Sequence
  Synthetic Polynucleotide
taatacgactcactatagggtccagaatttgctgtgctacttgcaagtccaacagaggagaggacttatgagtagcacaaacctggcggcagcgcaaaagatg

SEQ ID NO: 240171 - DNA, 103 bp, Artificial Sequence
  Synthetic Polynucleotide
taatacgactcactatagggtcttgatacatccagaatttgctgtgctacaacagaggagagtagcaatgcaaattctgaacctggcggcagcgcaaaagatg

SEQ ID NO: 240172 - DNA, 103 bp, Artificial Sequence
  Synthetic Polynucleotide
taatacgactcactatagggaagtctggcctcttgatacatccagaatttaacagaggagaaaattcatgatgtatcaaaacctggcggcagcgcaaaagatg

SEQ ID NO: 240173 - DNA, 103 bp, Artificial Sequence
  Synthetic Polynucleotide
taatacgactcactatagggcttaccacacaagtctggcctcttgatacaaacagaggagatgtatcatgaggccagacaacctggcggcagcgcaaaagatg

SEQ ID NO: 240174 - DNA, 103 bp, Artificial Sequence
  Synthetic Polynucleotide
taatacgactcactatagggttgccgcagagtgggcacgggtacttgcggaacagaggagaccgcaaatgcccgtgcccaacctggcggcagcgcaaaagatg

SEQ ID NO: 240175 - DNA, 103 bp, Artificial Sequence
  Synthetic Polynucleotide
taatacgactcactataggggtggggctcagcttccggctccgccgaagaaacagaggagatcttcgatggagccggaaaacctggcggcagcgcaaaagatg

SEQ ID NO: 240176 - DNA, 103 bp, Artificial Sequence
  Synthetic Polynucleotide
taatacgactcactataggggcggaagcgcttgccgcagagtgggcacggaacagaggagaccgtgcatgctctgcggcaacctggcggcagcgcaaaagatg

SEQ ID NO: 240177 - DNA, 103 bp, Artificial Sequence
  Synthetic Polynucleotide
taatacgactcactatagggtgctgttgaagcggaagcgcttgccgcagaaacagaggagatctgcgatgagcgcttccaacctggcggcagcgcaaaagatg

SEQ ID NO: 240178 - DNA, 103 bp, Artificial Sequence
  Synthetic Polynucleotide
taatacgactcactatagggagggagaggatgctgttgaagcggaagcgcaacagaggagagcgcttatgcttcaacagaacctggcggcagcgcaaaagatg

SEQ ID NO: 240179 - DNA, 103 bp, Artificial Sequence
  Synthetic Polynucleotide
taatacgactcactataggggcgcatgtgcagggagaggatgctgttgaaaacagaggagattcaacatgatcctctccaacctggcggcagcgcaaaagatg

SEQ ID NO: 240180 - DNA, 103 bp, Artificial Sequence
  Synthetic Polynucleotide
taatacgactcactatagggccgtgtgcgtgcgcatgtgcagggagaggaaacagaggagatcctctatgtgcacatgcaacctggcggcagcgcaaaagatg

SEQ ID NO: 240181 - DNA, 103 bp, Artificial Sequence
  Synthetic Polynucleotide
taatacgactcactatagggggcttctcgcccgtgtgcgtgcgcatgtgcaacagaggagagcacatatgcacgcacacaacctggcggcagcgcaaaagatg

SEQ ID NO: 240182 - DNA, 103 bp, Artificial Sequence
  Synthetic Polynucleotide
taatacgactcactataggggcacttgaagggcttctcgcccgtgtgcgtaacagaggagaacgcacatgggcgagaagaacctggcggcagcgcaaaagatg

SEQ ID NO: 240183 - DNA, 103 bp, Artificial Sequence
  Synthetic Polynucleotide
taatacgactcactatagggcgcagtacgggcacttgaagggcttctcgcaacagaggagagcgagaatgccttcaagtaacctggcggcagcgcaaaagatg

SEQ ID NO: 240184 - DNA, 103 bp, Artificial Sequence
  Synthetic Polynucleotide
taatacgactcactataggggccctgtggtcgcagtacgggcacttgaagaacagaggagacttcaaatgcccgtactgaacctggcggcagcgcaaaagatg

SEQ ID NO: 240185 - DNA, 103 bp, Artificial Sequence
  Synthetic Polynucleotide
taatacgactcactatagggcttctgcgccgccctgtggtcgcagtacggaacagaggagaccgtacatggaccacaggaacctggcggcagcgcaaaagatg

SEQ ID NO: 240186 - DNA, 103 bp, Artificial Sequence
  Synthetic Polynucleotide
taatacgactcactatagggggccactcaggtggggctcagcttccggctaacagaggagaagccggatgctgagccccaacctggcggcagcgcaaaagatg

SEQ ID NO: 240187 - DNA, 103 bp, Artificial Sequence
  Synthetic Polynucleotide
taatacgactcactatagggtgaggttccccttctgcgccgccctgtggtaacagaggagaaccacaatgcggcgcagaaacctggcggcagcgcaaaagatg

SEQ ID NO: 240188 - DNA, 103 bp, Artificial Sequence
  Synthetic Polynucleotide
taatacgactcactatagggaggtgaatcttgaggttccccttctgcgccaacagaggagaggcgcaatgggggaacctaacctggcggcagcgcaaaagatg

SEQ ID NO: 240189 - DNA, 103 bp, Artificial Sequence
  Synthetic Polynucleotide
taatacgactcactataggggtgggtccgcaggtgaatcttgaggttcccaacagaggagagggaacatgaagattcacaacctggcggcagcgcaaaagatg

SEQ ID NO: 240190 - DNA, 103 bp, Artificial Sequence
  Synthetic Polynucleotide
taatacgactcactatagggtgcccagcttgtgggtccgcaggtgaatctaacagaggagaagattcatgtgcggacccaacctggcggcagcgcaaaagatg

SEQ ID NO: 240191 - DNA, 103 bp, Artificial Sequence
  Synthetic Polynucleotide
taatacgactcactatagggttgcccaggttgcccagcttgtgggtccgcaacagaggagagcggacatgcaagctgggaacctggcggcagcgcaaaagatg

SEQ ID NO: 240192 - DNA, 103 bp, Artificial Sequence
  Synthetic Polynucleotide
taatacgactcactatagggcccacgccccttgcccaggttgcccagcttaacagaggagaaagctgatgaacctgggcaacctggcggcagcgcaaaagatg

SEQ ID NO: 240193 - DNA, 103 bp, Artificial Sequence
  Synthetic Polynucleotide
taatacgactcactatagggcgcgcacacgcccacgccccttgcccaggtaacagaggagaacctggatgaggggcgtgaacctggcggcagcgcaaaagatg

SEQ ID NO: 240194 - DNA, 103 bp, Artificial Sequence
  Synthetic Polynucleotide
taatacgactcactatagggcggttctcctcgcgcacacgcccacgccccaacagaggagaggggcgatggcgtgtgcgaacctggcggcagcgcaaaagatg

SEQ ID NO: 240195 - DNA, 103 bp, Artificial Sequence
  Synthetic Polynucleotide
taatacgactcactataggggtgcagcaggcggttctcctcgcgcacacgaacagaggagacgtgtgatggaggagaacaacctggcggcagcgcaaaagatg

SEQ ID NO: 240196 - DNA, 103 bp, Artificial Sequence
  Synthetic Polynucleotide
taatacgactcactatagggcctccagctcgtgcagcaggcggttctcctaacagaggagaaggagaatggcctgctgcaacctggcggcagcgcaaaagatg

SEQ ID NO: 240197 - DNA, 103 bp, Artificial Sequence
  Synthetic Polynucleotide
taatacgactcactatagggttgaggacggggccactcaggtggggctcaaacagaggagatgagccatgcctgagtggaacctggcggcagcgcaaaagatg

SEQ ID NO: 240198 - DNA, 103 bp, Artificial Sequence
  Synthetic Polynucleotide
taatacgactcactatagggatggcgcgctcctccagctcgtgcagcaggaacagaggagacctgctatgcgagctggaaacctggcggcagcgcaaaagatg

SEQ ID NO: 240199 - DNA, 103 bp, Artificial Sequence
  Synthetic Polynucleotide
taatacgactcactataggggtcccgcaggatggcgcgctcctccagctcaacagaggagagagctgatggagcgcgccaacctggcggcagcgcaaaagatg

SEQ ID NO: 240200 - DNA, 103 bp, Artificial Sequence
  Synthetic Polynucleotide
taatacgactcactatagggtcagctgcttgtcccgcaggatggcgcgctaacagaggagaagcgcgatgtcctgcgggaacctggcggcagcgcaaaagatg

SEQ ID NO: 240201 - DNA, 103 bp, Artificial Sequence
  Synthetic Polynucleotide
taatacgactcactatagggaggctgcctttcagctgcttgtcccgcaggaacagaggagacctgcgatgcaagcagctaacctggcggcagcgcaaaagatg

SEQ ID NO: 240202 - DNA, 103 bp, Artificial Sequence
  Synthetic Polynucleotide
taatacgactcactataggggggctgcagcaggctgcctttcagctgcttaacagaggagaaagcagatgaaaggcagcaacctggcggcagcgcaaaagatg

SEQ ID NO: 240203 - DNA, 103 bp, Artificial Sequence
  Synthetic Polynucleotide
taatacgactcactatagggggtccggccggggctgcagcaggctgccttaacagaggagaaaggcaatgtgctgcagcaacctggcggcagcgcaaaagatg

SEQ ID NO: 240204 - DNA, 103 bp, Artificial Sequence
  Synthetic Polynucleotide
taatacgactcactataggggggggcttcaggtccggccggggctgcagcaacagaggagagctgcaatgccggccggaaacctggcggcagcgcaaaagatg

SEQ ID NO: 240205 - DNA, 103 bp, Artificial Sequence
  Synthetic Polynucleotide
taatacgactcactatagggggcgtgcggcgggggcttcaggtccggccgaacagaggagacggccgatgctgaagcccaacctggcggcagcgcaaaagatg

SEQ ID NO: 240206 - DNA, 103 bp, Artificial Sequence
  Synthetic Polynucleotide
taatacgactcactataggggggcctgctgggcgtgcggcgggggcttcaaacagaggagatgaagcatgcgccgcacgaacctggcggcagcgcaaaagatg

SEQ ID NO: 240207 - DNA, 103 bp, Artificial Sequence
  Synthetic Polynucleotide
taatacgactcactataggggcggccagcggggcctgctgggcgtgcggcaacagaggagagccgcaatgccagcaggcaacctggcggcagcgcaaaagatg

SEQ ID NO: 240208 - DNA, 103 bp, Artificial Sequence
  Synthetic Polynucleotide
taatacgactcactatagggatactggccgttgaggacggggccactcagaacagaggagactgagtatgcccgtcctcaacctggcggcagcgcaaaagatg

SEQ ID NO: 240209 - DNA, 103 bp, Artificial Sequence
  Synthetic Polynucleotide
taatacgactcactatagggcagggtgcaggcggccagcggggcctgctgaacagaggagacagcagatgccgctggccaacctggcggcagcgcaaaagatg

SEQ ID NO: 240210 - DNA, 103 bp, Artificial Sequence
  Synthetic Polynucleotide
taatacgactcactatagggcctgcagggccagggtgcaggcggccagcgaacagaggagacgctggatgcctgcacccaacctggcggcagcgcaaaagatg

SEQ ID NO: 240211 - DNA, 103 bp, Artificial Sequence
  Synthetic Polynucleotide
taatacgactcactatagggctgtggttagcctgcagggccagggtgcagaacagaggagactgcacatgggccctgcaaacctggcggcagcgcaaaagatg

SEQ ID NO: 240212 - DNA, 103 bp, Artificial Sequence
  Synthetic Polynucleotide
taatacgactcactataggggtcgggaacgctgtggttagcctgcagggcaacagaggagagccctgatggctaaccacaacctggcggcagcgcaaaagatg

SEQ ID NO: 240213 - DNA, 103 bp, Artificial Sequence
  Synthetic Polynucleotide
taatacgactcactatagggggtgggccacgtcgggaacgctgtggttagaacagaggagactaaccatggcgttcccgaacctggcggcagcgcaaaagatg

SEQ ID NO: 240214 - DNA, 103 bp, Artificial Sequence
  Synthetic Polynucleotide
taatacgactcactataggggagggcaccgggtgggccacgtcgggaacgaacagaggagacgttccatgcgtggcccaaacctggcggcagcgcaaaagatg

SEQ ID NO: 240215 - DNA, 103 bp, Artificial Sequence
  Synthetic Polynucleotide
taatacgactcactatagggaggcttgggcgagggcaccgggtgggccacaacagaggagagtggccatgccggtgcccaacctggcggcagcgcaaaagatg

SEQ ID NO: 240216 - DNA, 103 bp, Artificial Sequence
  Synthetic Polynucleotide
taatacgactcactataggggcacgctggcaggcttgggcgagggcaccgaacagaggagacggtgcatgcgcccaagcaacctggcggcagcgcaaaagatg

SEQ ID NO: 240217 - DNA, 103 bp, Artificial Sequence
  Synthetic Polynucleotide
taatacgactcactataggggcgtcctcctgcacgctggcaggcttgggcaacagaggagagcccaaatgtgccagcgtaacctggcggcagcgcaaaagatg

SEQ ID NO: 240218 - DNA, 103 bp, Artificial Sequence
  Synthetic Polynucleotide
taatacgactcactatagggcggggccaccgcgtcctcctgcacgctggcaacagaggagagccagcatgcaggaggacaacctggcggcagcgcaaaagatg

SEQ ID NO: 240219 - DNA, 103 bp, Artificial Sequence
  Synthetic Polynucleotide
taatacgactcactataggggactcatggcatactggccgttgaggacggaacagaggagaccgtccatgacggccagtaacctggcggcagcgcaaaagatg

SEQ ID NO: 240220 - DNA, 103 bp, Artificial Sequence
  Synthetic Polynucleotide
taatacgactcactatagggagcccgccgccggggccaccgcgtcctcctaacagaggagaaggaggatgcggtggcccaacctggcggcagcgcaaaagatg

SEQ ID NO: 240221 - DNA, 103 bp, Artificial Sequence
  Synthetic Polynucleotide
taatacgactcactataggggtacagcggaagcccgccgccggggccaccaacagaggagaggtggcatgggcggcgggaacctggcggcagcgcaaaagatg

SEQ ID NO: 240222 - DNA, 103 bp, Artificial Sequence
  Synthetic Polynucleotide
taatacgactcactatagggcttgcagaaggtacagcggaagcccgccgcaacagaggagagcggcgatgttccgctgtaacctggcggcagcgcaaaagatg

SEQ ID NO: 240223 - DNA, 103 bp, Artificial Sequence
  Synthetic Polynucleotide
taatacgactcactatagggtgaacttgcccttgcagaaggtacagcggaaacagaggagatccgctatgccttctgcaaacctggcggcagcgcaaaagatg

SEQ ID NO: 240224 - DNA, 103 bp, Artificial Sequence
  Synthetic Polynucleotide
taatacgactcactatagggtcgcgcttcttgaacttgcccttgcagaagaacagaggagacttctgatggggcaagttaacctggcggcagcgcaaaagatg

SEQ ID NO: 240225 - DNA, 103 bp, Artificial Sequence
  Synthetic Polynucleotide
taatacgactcactataggggtccagctcctcgcgcttcttgaacttgccaacagaggagaggcaagatgaagaagcgcaacctggcggcagcgcaaaagatg

SEQ ID NO: 240226 - DNA, 103 bp, Artificial Sequence
  Synthetic Polynucleotide
taatacgactcactatagggggatgtggcggtccagctcctcgcgcttctaacagaggagaagaagcatgaggagctggaacctggcggcagcgcaaaagatg

SEQ ID NO: 240227 - DNA, 103 bp, Artificial Sequence
  Synthetic Polynucleotide
taatacgactcactatagggtgcaagatgcggatgtggcggtccagctccaacagaggagaggagctatgccgccacataacctggcggcagcgcaaaagatg

SEQ ID NO: 240228 - DNA, 103 bp, Artificial Sequence
  Synthetic Polynucleotide
taatacgactcactataggggtagggcttgtgcaagatgcggatgtggcgaacagaggagacgccacatgcgcatcttgaacctggcggcagcgcaaaagatg

SEQ ID NO: 240229 - DNA, 103 bp, Artificial Sequence
  Synthetic Polynucleotide
taatacgactcactatagggacgtgcacttgtagggcttgtgcaagatgcaacagaggagagcatctatgacaagccctaacctggcggcagcgcaaaagatg

SEQ ID NO: 240230 - DNA, 103 bp, Artificial Sequence
  Synthetic Polynucleotide
taatacgactcactatagggtgcagcttctgactcatggcatactggccgaacagaggagacggccaatgtgccatgagaacctggcggcagcgcaaaagatg

SEQ ID NO: 240231 - DNA, 103 bp, Artificial Sequence
  Synthetic Polynucleotide
taatacgactcactatagggaagtcgcacaacgtgcacttgtagggcttgaacagaggagacaagccatgcaagtgcacaacctggcggcagcgcaaaagatg

SEQ ID NO: 240232 - DNA, 103 bp, Artificial Sequence
  Synthetic Polynucleotide
taatacgactcactatagggcgaagccgcgaagtcgcacaacgtgcacttaacagaggagaaagtgcatgttgtgcgacaacctggcggcagcgcaaaagatg

SEQ ID NO: 240233 - DNA, 103 bp, Artificial Sequence
  Synthetic Polynucleotide
taatacgactcactatagggcctcctcctgcgaagccgcgaagtcgcacaaacagaggagatgtgcgatgtcgcggcttaacctggcggcagcgcaaaagatg

SEQ ID NO: 240234 - DNA, 103 bp, Artificial Sequence
  Synthetic Polynucleotide
taatacgactcactatagggctgatgagctcctcctcctgcgaagccgcgaacagaggagacgcggcatggcaggaggaaacctggcggcagcgcaaaagatg

SEQ ID NO: 240235 - DNA, 103 bp, Artificial Sequence
  Synthetic Polynucleotide
taatacgactcactatagggctccacgtggctgatgagctcctcctcctgaacagaggagacaggagatggagctcatcaacctggcggcagcgcaaaagatg

SEQ ID NO: 240236 - DNA, 103 bp, Artificial Sequence
  Synthetic Polynucleotide
taatacgactcactatagggtgtgtgccttctccacgtggctgatgagctaacagaggagaagctcaatggccacgtggaacctggcggcagcgcaaaagatg

SEQ ID NO: 240237 - DNA, 103 bp, Artificial Sequence
  Synthetic Polynucleotide
taatacgactcactatagggtcggccgtgatgtgtgccttctccacgtggaacagaggagaccacgtatggaaggcacaaacctggcggcagcgcaaaagatg

SEQ ID NO: 240238 - DNA, 103 bp, Artificial Sequence
  Synthetic Polynucleotide
taatacgactcactatagggctgggccgactcggccgtgatgtgtgccttaacagaggagaaaggcaatgatcacggccaacctggcggcagcgcaaaagatg

SEQ ID NO: 240239 - DNA, 103 bp, Artificial Sequence
  Synthetic Polynucleotide
taatacgactcactatagggggccctggccctgggccgactcggccgtgaaacagaggagatcacggatgagtcggcccaacctggcggcagcgcaaaagatg

SEQ ID NO: 240240 - DNA, 103 bp, Artificial Sequence
  Synthetic Polynucleotide
taatacgactcactatagggccgccgttggggccctggccctgggccgacaacagaggagagtcggcatggggccagggaacctggcggcagcgcaaaagatg

SEQ ID NO: 240241 - DNA, 103 bp, Artificial Sequence
  Synthetic Polynucleotide
taatacgactcactatagggaccctcgtctccaaggctgtactggtccataacagaggagaatggacatgtacagccttaacctggcggcagcgcaaaagatg

SEQ ID NO: 240242 - DNA, 103 bp, Artificial Sequence
  Synthetic Polynucleotide
taatacgactcactataggggttgggacccaaatcccggttgagggtgtcaacagaggagagacaccatgaaccgggataacctggcggcagcgcaaaagatg

SEQ ID NO: 240243 - DNA, 103 bp, Artificial Sequence
  Synthetic Polynucleotide
taatacgactcactataggggaggcaaggctcctcgggaagctcggtgtcaacagaggagagacaccatgcttcccgagaacctggcggcagcgcaaaagatg

SEQ ID NO: 240244 - DNA, 103 bp, Artificial Sequence
  Synthetic Polynucleotide
taatacgactcactatagggctttctgtgggaggcaaggctcctcgggaaaacagaggagattcccgatgagccttgccaacctggcggcagcgcaaaagatg

SEQ ID NO: 240245 - DNA, 103 bp, Artificial Sequence
  Synthetic Polynucleotide
taatacgactcactataggggtggccggctctttctgtgggaggcaaggcaacagaggagagccttgatgcccacagaaaacctggcggcagcgcaaaagatg

SEQ ID NO: 240246 - DNA, 103 bp, Artificial Sequence
  Synthetic Polynucleotide
taatacgactcactataggggaacacgtcagtggccggctctttctgtggaacagaggagaccacagatggagccggccaacctggcggcagcgcaaaagatg

SEQ ID NO: 240247 - DNA, 103 bp, Artificial Sequence
  Synthetic Polynucleotide
taatacgactcactatagggtaggggctgtgaacacgtcagtggccggctaacagaggagaagccggatgctgacgtgtaacctggcggcagcgcaaaagatg

SEQ ID NO: 240248 - DNA, 103 bp, Artificial Sequence
  Synthetic Polynucleotide
taatacgactcactataggggccctggaattaggggctgtgaacacgtcaaacagaggagatgacgtatgcacagccccaacctggcggcagcgcaaaagatg

SEQ ID NO: 240249 - DNA, 103 bp, Artificial Sequence
  Synthetic Polynucleotide
taatacgactcactataggggttctcggcggccctggaattaggggctgtaacagaggagaacagccatgaattccaggaacctggcggcagcgcaaaagatg

SEQ ID NO: 240250 - DNA, 103 bp, Artificial Sequence
  Synthetic Polynucleotide
taatacgactcactatagggcgggggcgccgttctcggcggccctggaataacagaggagaattccaatgccgccgagaaacctggcggcagcgcaaaagatg

SEQ ID NO: 240251 - DNA, 103 bp, Artificial Sequence
  Synthetic Polynucleotide
taatacgactcactatagggtctggcgggtcgggggcgccgttctcggcgaacagaggagacgccgaatgcggcgccccaacctggcggcagcgcaaaagatg

SEQ ID NO: 240252 - DNA, 103 bp, Artificial Sequence
  Synthetic Polynucleotide
taatacgactcactatagggtggctccggctctggcgggtcgggggcgccaacagaggagaggcgccatggacccgccaaacctggcggcagcgcaaaagatg

SEQ ID NO: 240253 - DNA, 103 bp, Artificial Sequence
  Synthetic Polynucleotide
taatacgactcactatagggagcctcgcgtgttgggacccaaatcccggtaacagaggagaaccgggatgtgggtcccaaacctggcggcagcgcaaaagatg

SEQ ID NO: 240254 - DNA, 103 bp, Artificial Sequence
  Synthetic Polynucleotide
taatacgactcactataggggcgcggtatctggctccggctctggcgggtaacagaggagaacccgcatgagccggagcaacctggcggcagcgcaaaagatg

SEQ ID NO: 240255 - DNA, 103 bp, Artificial Sequence
  Synthetic Polynucleotide
taatacgactcactataggggcctggagcagcgcggtatctggctccggcaacagaggagagccggaatgagataccgcaacctggcggcagcgcaaaagatg

SEQ ID NO: 240256 - DNA, 103 bp, Artificial Sequence
  Synthetic Polynucleotide
taatacgactcactatagggggtggaccgggcctggagcagcgcggtatcaacagaggagagataccatgctgctccagaacctggcggcagcgcaaaagatg

SEQ ID NO: 240257 - DNA, 103 bp, Artificial Sequence
  Synthetic Polynucleotide
taatacgactcactatagggagcactccgcggtggaccgggcctggagcaaacagaggagatgctccatgcccggtccaaacctggcggcagcgcaaaagatg

SEQ ID NO: 240258 - DNA, 103 bp, Artificial Sequence
  Synthetic Polynucleotide
taatacgactcactatagggccttcgggccagcactccgcggtggaccggaacagaggagaccggtcatgcgcggagtgaacctggcggcagcgcaaaagatg

SEQ ID NO: 240259 - DNA, 103 bp, Artificial Sequence
  Synthetic Polynucleotide
taatacgactcactatagggcacggagccgccttcgggccagcactccgcaacagaggagagcggagatgtggcccgaaaacctggcggcagcgcaaaagatg

SEQ ID NO: 240260 - DNA, 103 bp, Artificial Sequence
  Synthetic Polynucleotide
taatacgactcactatagggggcaggcaggcacggagccgccttcgggccaacagaggagaggcccgatggcggctccgaacctggcggcagcgcaaaagatg

SEQ ID NO: 240261 - DNA, 103 bp, Artificial Sequence
  Synthetic Polynucleotide
taatacgactcactatagggaagagaggcaggcaggcaggcacggagccgaacagaggagacggctcatggcctgcctgaacctggcggcagcgcaaaagatg

SEQ ID NO: 240262 - DNA, 103 bp, Artificial Sequence
  Synthetic Polynucleotide
taatacgactcactatagggctggcctcggaagagaggcaggcaggcaggaacagaggagacctgccatgctgcctctcaacctggcggcagcgcaaaagatg

SEQ ID NO: 240263 - DNA, 103 bp, Artificial Sequence
  Synthetic Polynucleotide
taatacgactcactatagggcagggaccgtctggcctcggaagagaggcaaacagaggagatgcctcatgtccgaggccaacctggcggcagcgcaaaagatg

SEQ ID NO: 240264 - DNA, 103 bp, Artificial Sequence
  Synthetic Polynucleotide
taatacgactcactataggggcataaagaaagcctcgcgtgttgggacccaacagaggagagggtccatgcacgcgaggaacctggcggcagcgcaaaagatg

SEQ ID NO: 240265 - DNA, 103 bp, Artificial Sequence
  Synthetic Polynucleotide
taatacgactcactatagggtgggaactggcagggaccgtctggcctcggaacagaggagaccgaggatggacggtcccaacctggcggcagcgcaaaagatg

SEQ ID NO: 240266 - DNA, 103 bp, Artificial Sequence
  Synthetic Polynucleotide
taatacgactcactataggggctcgatggctgggaactggcagggaccgtaacagaggagaacggtcatggccagttccaacctggcggcagcgcaaaagatg

SEQ ID NO: 240267 - DNA, 103 bp, Artificial Sequence
  Synthetic Polynucleotide
taatacgactcactatagggggaagctgtggctcgatggctgggaactggaacagaggagaccagttatgagccatcgaaacctggcggcagcgcaaaagatg

SEQ ID NO: 240268 - DNA, 103 bp, Artificial Sequence
  Synthetic Polynucleotide
taatacgactcactatagggcggagccactggaagctgtggctcgatggcaacagaggagagccatcatgccacagcttaacctggcggcagcgcaaaagatg

SEQ ID NO: 240269 - DNA, 103 bp, Artificial Sequence
  Synthetic Polynucleotide
taatacgactcactatagggcggcaggttccggagccactggaagctgtgaacagaggagacacagcatgcagtggctcaacctggcggcagcgcaaaagatg

SEQ ID NO: 240270 - DNA, 103 bp, Artificial Sequence
  Synthetic Polynucleotide
taatacgactcactatagggtgggacagcccggcaggttccggagccactaacagaggagaagtggcatgggaacctgcaacctggcggcagcgcaaaagatg

SEQ ID NO: 240271 - DNA, 103 bp, Artificial Sequence
  Synthetic Polynucleotide
taatacgactcactatagggcctttgcttttgggacagcccggcaggttcaacagaggagagaacctatggggctgtccaacctggcggcagcgcaaaagatg

SEQ ID NO: 240272 - DNA, 103 bp, Artificial Sequence
  Synthetic Polynucleotide
taatacgactcactatagggcacgttgttgcctttgcttttgggacagccaacagaggagaggctgtatgaaaagcaaaaacctggcggcagcgcaaaagatg

SEQ ID NO: 240273 - DNA, 103 bp, Artificial Sequence
  Synthetic Polynucleotide
taatacgactcactatagggggacaacaaacacgttgttgcctttgctttaacagaggagaaaagcaatggcaacaacgaacctggcggcagcgcaaaagatg

SEQ ID NO: 240274 - DNA, 103 bp, Artificial Sequence
  Synthetic Polynucleotide
taatacgactcactataggggagggcttgtggacaacaaacacgttgttgaacagaggagacaacaaatggtttgttgtaacctggcggcagcgcaaaagatg

SEQ ID NO: 240275 - DNA, 103 bp, Artificial Sequence
  Synthetic Polynucleotide
taatacgactcactatagggactcaggccagcataaagaaagcctcgcgtaacagaggagaacgcgaatgtttctttataacctggcggcagcgcaaaagatg

SEQ ID NO: 240276 - DNA, 103 bp, Artificial Sequence
  Synthetic Polynucleotide
taatacgactcactataggggggcacggccgagggcttgtggacaacaaaaacagaggagatttgttatgcacaagcccaacctggcggcagcgcaaaagatg

SEQ ID NO: 240277 - DNA, 103 bp, Artificial Sequence
  Synthetic Polynucleotide
taatacgactcactatagggcctcccgcgagggcacggccgagggcttgtaacagaggagaacaagcatgcggccgtgcaacctggcggcagcgcaaaagatg

SEQ ID NO: 240278 - DNA, 103 bp, Artificial Sequence
  Synthetic Polynucleotide
taatacgactcactataggggactcggagccctcccgcgagggcacggccaacagaggagaggccgtatgctcgcgggaaacctggcggcagcgcaaaagatg

SEQ ID NO: 240279 - DNA, 103 bp, Artificial Sequence
  Synthetic Polynucleotide
taatacgactcactatagggtcccgggccagactcggagccctcccgcgaaacagaggagatcgcggatgggctccgagaacctggcggcagcgcaaaagatg

SEQ ID NO: 240280 - DNA, 103 bp, Artificial Sequence
  Synthetic Polynucleotide
taatacgactcactatagggcgctgctgggtcccgggccagactcggagcaacagaggagagctccgatgctggcccggaacctggcggcagcgcaaaagatg

SEQ ID NO: 240281 - DNA, 103 bp, Artificial Sequence
  Synthetic Polynucleotide
taatacgactcactataggggaggggcttccgctgctgggtcccgggccaaacagaggagatggcccatgacccagcagaacctggcggcagcgcaaaagatg

SEQ ID NO: 240282 - DNA, 103 bp, Artificial Sequence
  Synthetic Polynucleotide
taatacgactcactatagggggactcctccgaggggcttccgctgctgggaacagaggagacccagcatgggaagccccaacctggcggcagcgcaaaagatg

SEQ ID NO: 240283 - DNA, 103 bp, Artificial Sequence
  Synthetic Polynucleotide
taatacgactcactatagggggccgggcggggactcctccgaggggcttcaacagaggagagaagccatgcggaggagtaacctggcggcagcgcaaaagatg

SEQ ID NO: 240284 - DNA, 103 bp, Artificial Sequence
  Synthetic Polynucleotide
taatacgactcactatagggccaccgccggggccgggcggggactcctccaacagaggagaggaggaatgcccgcccggaacctggcggcagcgcaaaagatg

SEQ ID NO: 240285 - DNA, 103 bp, Artificial Sequence
  Synthetic Polynucleotide
taatacgactcactatagggatcctccaggccaccgccggggccgggcggaacagaggagaccgcccatgcccggcggtaacctggcggcagcgcaaaagatg

SEQ ID NO: 240286 - DNA, 103 bp, Artificial Sequence
  Synthetic Polynucleotide
taatacgactcactatagggggtccagaccactcaggccagcataaagaaaacagaggagattctttatgctggcctgaaacctggcggcagcgcaaaagatg

SEQ ID NO: 240287 - DNA, 103 bp, Artificial Sequence
  Synthetic Polynucleotide
taatacgactcactatagggagggcagagcatcctccaggccaccgccggaacagaggagaccggcgatggcctggaggaacctggcggcagcgcaaaagatg

SEQ ID NO: 240288 - DNA, 103 bp, Artificial Sequence
  Synthetic Polynucleotide
taatacgactcactataggggcggcagggaagggcagagcatcctccaggaacagaggagacctggaatgtgctctgccaacctggcggcagcgcaaaagatg

SEQ ID NO: 240289 - DNA, 103 bp, Artificial Sequence
  Synthetic Polynucleotide
taatacgactcactatagggcctgaggagcgcggcagggaagggcagagcaacagaggagagctctgatgttccctgccaacctggcggcagcgcaaaagatg

SEQ ID NO: 240290 - DNA, 103 bp, Artificial Sequence
  Synthetic Polynucleotide
taatacgactcactatagggccgcggggaccctgaggagcgcggcagggaaacagaggagatccctgatgcgctcctcaaacctggcggcagcgcaaaagatg

SEQ ID NO: 240291 - DNA, 103 bp, Artificial Sequence
  Synthetic Polynucleotide
taatacgactcactatagggctcggggcctccgcggggaccctgaggagcaacagaggagagctcctatgggtccccgcaacctggcggcagcgcaaaagatg

SEQ ID NO: 240292 - DNA, 103 bp, Artificial Sequence
  Synthetic Polynucleotide
taatacgactcactatagggcctggggtcgctcggggcctccgcggggacaacagaggagagtccccatggaggccccgaacctggcggcagcgcaaaagatg

SEQ ID NO: 240293 - DNA, 103 bp, Artificial Sequence
  Synthetic Polynucleotide
taatacgactcactatagggcgctggccgacctggggtcgctcggggcctaacagaggagaaggcccatggcgaccccaaacctggcggcagcgcaaaagatg

SEQ ID NO: 240294 - DNA, 103 bp, Artificial Sequence
  Synthetic Polynucleotide
taatacgactcactatagggtcatcttccccgctggccgacctggggtcgaacagaggagacgacccatggtcggccagaacctggcggcagcgcaaaagatg

SEQ ID NO: 240295 - DNA, 103 bp, Artificial Sequence
  Synthetic Polynucleotide
taatacgactcactatagggggcgcaggggtcatcttccccgctggccgaaacagaggagatcggccatgggggaagataacctggcggcagcgcaaaagatg

SEQ ID NO: 240296 - DNA, 103 bp, Artificial Sequence
  Synthetic Polynucleotide
taatacgactcactatagggccttcttgggggcgcaggggtcatcttcccaacagaggagagggaagatgacccctgcgaacctggcggcagcgcaaaagatg

SEQ ID NO: 240297 - DNA, 103 bp, Artificial Sequence
  Synthetic Polynucleotide
taatacgactcactatagggctggggtccgggtccagaccactcaggccaaacagaggagatggcctatgtggtctggaaacctggcggcagcgcaaaagatg

SEQ ID NO: 240298 - DNA, 103 bp, Artificial Sequence
  Synthetic Polynucleotide
taatacgactcactatagggtcgaccttgaccttcttgggggcgcaggggaacagaggagacccctgatgccccaagaaaacctggcggcagcgcaaaagatg

SEQ ID NO: 240299 - DNA, 103 bp, Artificial Sequence
  Synthetic Polynucleotide
taatacgactcactatagggggagtcgcagtcgaccttgaccttcttgggaacagaggagacccaagatggtcaaggtcaacctggcggcagcgcaaaagatg

SEQ ID NO: 240300 - DNA, 103 bp, Artificial Sequence
  Synthetic Polynucleotide
taatacgactcactatagggggcacaggaaggagtcgcagtcgaccttgaaacagaggagatcaaggatgactgcgactaacctggcggcagcgcaaaagatg

SEQ ID NO: 240301 - DNA, 103 bp, Artificial Sequence
  Synthetic Polynucleotide
taatacgactcactatagggccggggttctggcacaggaaggagtcgcagaacagaggagactgcgaatgcttcctgtgaacctggcggcagcgcaaaagatg

SEQ ID NO: 240302 - DNA, 103 bp, Artificial Sequence
  Synthetic Polynucleotide
taatacgactcactataggggccgggctccccggggttctggcacaggaaaacagaggagattcctgatgcagaaccccaacctggcggcagcgcaaaagatg

SEQ ID NO: 240303 - DNA, 103 bp, Artificial Sequence
  Synthetic Polynucleotide
taatacgactcactatagggcctcctggaggccgggctccccggggttctaacagaggagaagaaccatggggagcccgaacctggcggcagcgcaaaagatg

SEQ ID NO: 240304 - DNA, 103 bp, Artificial Sequence
  Synthetic Polynucleotide
taatacgactcactataggggccttctgggcctcctggaggccgggctccaacagaggagaggagccatgcctccaggaaacctggcggcagcgcaaaagatg

SEQ ID NO: 240305 - DNA, 103 bp, Artificial Sequence
  Synthetic Polynucleotide
taatacgactcactataggggagcccgcctgccttctgggcctcctggagaacagaggagactccagatggcccagaagaacctggcggcagcgcaaaagatg

SEQ ID NO: 240306 - DNA, 103 bp, Artificial Sequence
  Synthetic Polynucleotide
taatacgactcactatagggcatccgcagggagcccgcctgccttctgggaacagaggagacccagaatgcaggcgggcaacctggcggcagcgcaaaagatg

SEQ ID NO: 240307 - DNA, 103 bp, Artificial Sequence
  Synthetic Polynucleotide
taatacgactcactatagggagcggcgaggcatccgcagggagcccgcctaacagaggagaaggcggatgccctgcggaaacctggcggcagcgcaaaagatg

SEQ ID NO: 240308 - DNA, 103 bp, Artificial Sequence
  Synthetic Polynucleotide
taatacgactcactatagggcgttgggaggctggggtccgggtccagaccaacagaggagaggtctgatgccggaccccaacctggcggcagcgcaaaagatg

SEQ ID NO: 240309 - DNA, 103 bp, Artificial Sequence
  Synthetic Polynucleotide
taatacgactcactatagggctggcggaagagcggcgaggcatccgcaggaacagaggagacctgcgatggcctcgccgaacctggcggcagcgcaaaagatg

SEQ ID NO: 240310 - DNA, 103 bp, Artificial Sequence
  Synthetic Polynucleotide
taatacgactcactatagggtgaggaagagctggcggaagagcggcgaggaacagaggagacctcgcatgtcttccgccaacctggcggcagcgcaaaagatg

SEQ ID NO: 240311 - DNA, 103 bp, Artificial Sequence
  Synthetic Polynucleotide
taatacgactcactatagggtcctgcgacttgaggaagagctggcggaagaacagaggagacttccgatggctcttcctaacctggcggcagcgcaaaagatg

SEQ ID NO: 240312 - DNA, 103 bp, Artificial Sequence
  Synthetic Polynucleotide
taatacgactcactatagggcacaagaggttcctgcgacttgaggaagagaacagaggagactcttcatgaagtcgcagaacctggcggcagcgcaaaagatg

SEQ ID NO: 240313 - DNA, 103 bp, Artificial Sequence
  Synthetic Polynucleotide
taatacgactcactataggggctcgtggctcacaagaggttcctgcgactaacagaggagaagtcgcatgaacctcttgaacctggcggcagcgcaaaagatg

SEQ ID NO: 240314 - DNA, 103 bp, Artificial Sequence
  Synthetic Polynucleotide
taatacgactcactatagggacctgcatctgctcgtggctcacaagaggtaacagaggagaacctctatggagccacgaaacctggcggcagcgcaaaagatg

SEQ ID NO: 240315 - DNA, 103 bp, Artificial Sequence
  Synthetic Polynucleotide
taatacgactcactatagggcatctggaacacctgcatctgctcgtggctaacagaggagaagccacatgcagatgcagaacctggcggcagcgcaaaagatg

SEQ ID NO: 240316 - DNA, 103 bp, Artificial Sequence
  Synthetic Polynucleotide
taatacgactcactatagggacttggtgatcatctggaacacctgcatctaacagaggagaagatgcatgtgttccagaaacctggcggcagcgcaaaagatg

SEQ ID NO: 240317 - DNA, 103 bp, Artificial Sequence
  Synthetic Polynucleotide
taatacgactcactatagggatccgctgggacttggtgatcatctggaacaacagaggagagttccaatggatcaccaaaacctggcggcagcgcaaaagatg

SEQ ID NO: 240318 - DNA, 103 bp, Artificial Sequence
  Synthetic Polynucleotide
taatacgactcactatagggatgggagaagatccgctgggacttggtgataacagaggagaatcaccatgtcccagcggaacctggcggcagcgcaaaagatg

SEQ ID NO: 240319 - DNA, 103 bp, Artificial Sequence
  Synthetic Polynucleotide
taatacgactcactatagggacatgtcaggcgttgggaggctggggtccgaacagaggagacggaccatggcctcccaaaacctggcggcagcgcaaaagatg

SEQ ID NO: 240320 - DNA, 103 bp, Artificial Sequence
  Synthetic Polynucleotide
taatacgactcactatagggccacctgggcatgggagaagatccgctgggaacagaggagacccagcatgtcttctcccaacctggcggcagcgcaaaagatg

SEQ ID NO: 240321 - DNA, 103 bp, Artificial Sequence
  Synthetic Polynucleotide
taatacgactcactataggggagactgctgccacctgggcatgggagaagaacagaggagacttctcatgtgcccaggtaacctggcggcagcgcaaaagatg

SEQ ID NO: 240322 - DNA, 103 bp, Artificial Sequence
  Synthetic Polynucleotide
taatacgactcactataggggagctgggaggagactgctgccacctgggcaacagaggagagcccagatggcagcagtcaacctggcggcagcgcaaaagatg

SEQ ID NO: 240323 - DNA, 103 bp, Artificial Sequence
  Synthetic Polynucleotide
taatacgactcactatagggcgggcgcagggagctgggaggagactgctgaacagaggagacagcagatgcctcccagcaacctggcggcagcgcaaaagatg

SEQ ID NO: 240324 - DNA, 103 bp, Artificial Sequence
  Synthetic Polynucleotide
taatacgactcactatagggggtttgccctcgggcgcagggagctgggagaacagaggagactcccaatgccctgcgccaacctggcggcagcgcaaaagatg

SEQ ID NO: 240325 - DNA, 103 bp, Artificial Sequence
  Synthetic Polynucleotide
taatacgactcactatagggcagggcggctggtttgccctcgggcgcaggaacagaggagacctgcgatggagggcaaaaacctggcggcagcgcaaaagatg

SEQ ID NO: 240326 - DNA, 103 bp, Artificial Sequence
  Synthetic Polynucleotide
taatacgactcactataggggcagcggcctcagggcggctggtttgccctaacagaggagaagggcaatgcagccgcccaacctggcggcagcgcaaaagatg

SEQ ID NO: 240327 - DNA, 103 bp, Artificial Sequence
  Synthetic Polynucleotide
taatacgactcactatagggcacggcccctgcagcggcctcagggcggctaacagaggagaagccgcatggaggccgctaacctggcggcagcgcaaaagatg

SEQ ID NO: 240328 - DNA, 103 bp, Artificial Sequence
  Synthetic Polynucleotide
taatacgactcactatagggctgctgcggccacggcccctgcagcggcctaacagaggagaaggccgatgcaggggccgaacctggcggcagcgcaaaagatg

SEQ ID NO: 240329 - DNA, 103 bp, Artificial Sequence
  Synthetic Polynucleotide
taatacgactcactataggggtggtgggggctgctgcggccacggcccctaacagaggagaaggggcatgggccgcagcaacctggcggcagcgcaaaagatg

SEQ ID NO: 240330 - DNA, 103 bp, Artificial Sequence
  Synthetic Polynucleotide
taatacgactcactatagggacctcgctggacatgtcaggcgttgggaggaacagaggagacctcccatggcctgacataacctggcggcagcgcaaaagatg

SEQ ID NO: 240331 - DNA, 103 bp, Artificial Sequence
  Synthetic Polynucleotide
taatacgactcactataggggcaggagccagtggtgggggctgctgcggcaacagaggagagccgcaatggcccccaccaacctggcggcagcgcaaaagatg

SEQ ID NO: 240332 - DNA, 103 bp, Artificial Sequence
  Synthetic Polynucleotide
taatacgactcactatagggagagtccacagcaggagccagtggtgggggaacagaggagacccccaatgctggctcctaacctggcggcagcgcaaaagatg

SEQ ID NO: 240333 - DNA, 103 bp, Artificial Sequence
  Synthetic Polynucleotide
taatacgactcactatagggcggcgtggagagagtccacagcaggagccaaacagaggagatggctcatgctgtggactaacctggcggcagcgcaaaagatg

SEQ ID NO: 240334 - DNA, 103 bp, Artificial Sequence
  Synthetic Polynucleotide
taatacgactcactatagggtttccagggccggcgtggagagagtccacaaacagaggagatgtggaatgtctccacgcaacctggcggcagcgcaaaagatg

SEQ ID NO: 240335 - DNA, 103 bp, Artificial Sequence
  Synthetic Polynucleotide
taatacgactcactatagggtgcctcggggtttccagggccggcgtggagaacagaggagactccacatgggccctggaaacctggcggcagcgcaaaagatg

SEQ ID NO: 240336 - DNA, 103 bp, Artificial Sequence
  Synthetic Polynucleotide
taatacgactcactataggggggagccctctgcctcggggtttccagggcaacagaggagagccctgatgaccccgaggaacctggcggcagcgcaaaagatg

SEQ ID NO: 240337 - DNA, 103 bp, Artificial Sequence
  Synthetic Polynucleotide
taatacgactcactatagggctgcgggctggggagccctctgcctcggggaacagaggagaccccgaatgagagggctcaacctggcggcagcgcaaaagatg

SEQ ID NO: 240338 - DNA, 103 bp, Artificial Sequence
  Synthetic Polynucleotide
taatacgactcactatagggggtttttctcctgcgggctggggagccctcaacagaggagagagggcatgccagcccgcaacctggcggcagcgcaaaagatg

SEQ ID NO: 240339 - DNA, 103 bp, Artificial Sequence
  Synthetic Polynucleotide
taatacgactcactatagggccccgggtgtggtttttctcctgcgggctgaacagaggagacagcccatgggagaaaaaaacctggcggcagcgcaaaagatg

SEQ ID NO: 240340 - DNA, 103 bp, Artificial Sequence
  Synthetic Polynucleotide
taatacgactcactatagggtctctgggaaccccgggtgtggtttttctcaacagaggagagagaaaatgcacacccggaacctggcggcagcgcaaaagatg

SEQ ID NO: 240341 - DNA, 103 bp, Artificial Sequence
  Synthetic Polynucleotide
taatacgactcactataggggtcctccagcacctcgctggacatgtcaggaacagaggagacctgacatgtccagcgagaacctggcggcagcgcaaaagatg

SEQ ID NO: 240342 - DNA, 103 bp, Artificial Sequence
  Synthetic Polynucleotide
taatacgactcactataggggggggaggcctctctgggaaccccgggtgtaacagaggagaacacccatggttcccagaaacctggcggcagcgcaaaagatg

SEQ ID NO: 240343 - DNA, 103 bp, Artificial Sequence
  Synthetic Polynucleotide
taatacgactcactatagggtcgtgctgccgggggaggcctctctgggaaaacagaggagattcccaatgaggcctcccaacctggcggcagcgcaaaagatg

SEQ ID NO: 240344 - DNA, 103 bp, Artificial Sequence
  Synthetic Polynucleotide
taatacgactcactataggggcgtctcgtctcgtgctgccgggggaggccaacagaggagaggcctcatgcggcagcacaacctggcggcagcgcaaaagatg

SEQ ID NO: 240345 - DNA, 103 bp, Artificial Sequence
  Synthetic Polynucleotide
taatacgactcactatagggtcccccctttgcgtctcgtctcgtgctgccaacagaggagaggcagcatgagacgagacaacctggcggcagcgcaaaagatg

SEQ ID NO: 240346 - DNA, 103 bp, Artificial Sequence
  Synthetic Polynucleotide
taatacgactcactatagggccactttcagtcccccctttgcgtctcgtcaacagaggagagacgagatgcaaagggggaacctggcggcagcgcaaaagatg

SEQ ID NO: 240347 - DNA, 103 bp, Artificial Sequence
  Synthetic Polynucleotide
taatacgactcactatagggggaaccgcggccactttcagtcccccctttaacagaggagaaaagggatgactgaaagtaacctggcggcagcgcaaaagatg

SEQ ID NO: 240348 - DNA, 103 bp, Artificial Sequence
  Synthetic Polynucleotide
taatacgactcactatagggaaggggcgttggaaccgcggccactttcagaacagaggagactgaaaatggccgcggttaacctggcggcagcgcaaaagatg

SEQ ID NO: 240349 - DNA, 103 bp, Artificial Sequence
  Synthetic Polynucleotide
taatacgactcactatagggacggtgctgcaaggggcgttggaaccgcggaacagaggagaccgcggatgcaacgccccaacctggcggcagcgcaaaagatg

SEQ ID NO: 240350 - DNA, 103 bp, Artificial Sequence
  Synthetic Polynucleotide
taatacgactcactataggggggtccagagacggtgctgcaaggggcgttaacagaggagaaacgccatgtgcagcaccaacctggcggcagcgcaaaagatg

SEQ ID NO: 240351 - DNA, 103 bp, Artificial Sequence
  Synthetic Polynucleotide
taatacgactcactatagggattcctggaagggtccagagacggtgctgcaacagaggagagcagcaatgtctctggacaacctggcggcagcgcaaaagatg

SEQ ID NO: 240352 - DNA, 103 bp, Artificial Sequence
  Synthetic Polynucleotide
taatacgactcactatagggatgggagggcaccctcgtctccaaggctgtaacagaggagaacagccatggagacgaggaacctggcggcagcgcaaaagatg

SEQ ID NO: 240353 - DNA, 103 bp, Artificial Sequence
  Synthetic Polynucleotide
taatacgactcactatagggtgtctaagttgtcctccagcacctcgctggaacagaggagaccagcgatgtgctggaggaacctggcggcagcgcaaaagatg

SEQ ID NO: 240354 - DNA, 103 bp, Artificial Sequence
  Synthetic Polynucleotide
taatacgactcactatagggagatgtctggattcctggaagggtccagagaacagaggagactctggatgcttccaggaaacctggcggcagcgcaaaagatg

SEQ ID NO: 240355 - DNA, 103 bp, Artificial Sequence
  Synthetic Polynucleotide
taatacgactcactataggggccagagaagagatgtctggattcctggaaaacagaggagattccagatgtccagacataacctggcggcagcgcaaaagatg

SEQ ID NO: 240356 - DNA, 103 bp, Artificial Sequence
  Synthetic Polynucleotide
taatacgactcactatagggcagctgcttggccagagaagagatgtctggaacagaggagaccagacatgtcttctctgaacctggcggcagcgcaaaagatg

SEQ ID NO: 240357 - DNA, 103 bp, Artificial Sequence
  Synthetic Polynucleotide
taatacgactcactatagggtagaggatcgcagctgcttggccagagaagaacagaggagacttctcatgccaagcagcaacctggcggcagcgcaaaagatg

SEQ ID NO: 240358 - DNA, 103 bp, Artificial Sequence
  Synthetic Polynucleotide
taatacgactcactatagggaaggtccctttagaggatcgcagctgcttgaacagaggagacaagcaatggcgatcctcaacctggcggcagcgcaaaagatg

SEQ ID NO: 240359 - DNA, 103 bp, Artificial Sequence
  Synthetic Polynucleotide
taatacgactcactatagggctccaggtccaaggtccctttagaggatcgaacagaggagacgatccatgaaagggaccaacctggcggcagcgcaaaagatg

SEQ ID NO: 240360 - DNA, 103 bp, Artificial Sequence
  Synthetic Polynucleotide
taatacgactcactatagggggaagatgtcctccaggtccaaggtcccttaacagaggagaaagggaatgtggacctggaacctggcggcagcgcaaaagatg

SEQ ID NO: 240361 - DNA, 103 bp, Artificial Sequence
  Synthetic Polynucleotide
taatacgactcactatagggcctgtggaggggaagatgtcctccaggtccaacagaggagaggacctatgggacatcttaacctggcggcagcgcaaaagatg

SEQ ID NO: 240362 - DNA, 103 bp, Artificial Sequence
  Synthetic Polynucleotide
taatacgactcactatagggctgccgttggcctgtggaggggaagatgtcaacagaggagagacatcatgccctccacaaacctggcggcagcgcaaaagatg

SEQ ID NO: 240363 - DNA, 103 bp, Artificial Sequence
  Synthetic Polynucleotide
taatacgactcactatagggctaactgggtctgccgttggcctgtggaggaacagaggagacctccaatggccaacggcaacctggcggcagcgcaaaagatg

SEQ ID NO: 240364 - DNA, 103 bp, Artificial Sequence
  Synthetic Polynucleotide
taatacgactcactatagggagggacaaggtgtctaagttgtcctccagcaacagaggagagctggaatgcaacttagaaacctggcggcagcgcaaaagatg

SEQ ID NO: 240365 - DNA, 103 bp, Artificial Sequence
  Synthetic Polynucleotide
taatacgactcactatagggtcctccccacctaactgggtctgccgttggaacagaggagaccaacgatggacccagttaacctggcggcagcgcaaaagatg

SEQ ID NO: 240366 - DNA, 103 bp, Artificial Sequence
  Synthetic Polynucleotide
taatacgactcactatagggtcctggtggctcctccccacctaactgggtaacagaggagaacccagatgggtggggagaacctggcggcagcgcaaaagatg

SEQ ID NO: 240367 - DNA, 103 bp, Artificial Sequence
  Synthetic Polynucleotide
taatacgactcactataggggcagcgaggctcctggtggctcctccccacaacagaggagagtggggatgagccaccagaacctggcggcagcgcaaaagatg

SEQ ID NO: 240368 - DNA, 103 bp, Artificial Sequence
  Synthetic Polynucleotide
taatacgactcactatagggtgcttccctggcagcgaggctcctggtggcaacagaggagagccaccatgagcctcgctaacctggcggcagcgcaaaagatg

SEQ ID NO: 240369 - DNA, 103 bp, Artificial Sequence
  Synthetic Polynucleotide
taatacgactcactatagggggctggggcctgcttccctggcagcgaggcaacagaggagagcctcgatgccagggaagaacctggcggcagcgcaaaagatg

SEQ ID NO: 240370 - DNA, 103 bp, Artificial Sequence
  Synthetic Polynucleotide
taatacgactcactatagggcgccattctcggctggggcctgcttccctgaacagaggagacagggaatgaggccccagaacctggcggcagcgcaaaagatg

SEQ ID NO: 240371 - DNA, 103 bp, Artificial Sequence
  Synthetic Polynucleotide
taatacgactcactatagggcttgaagccgcgccattctcggctggggccaacagaggagaggccccatgcgagaatggaacctggcggcagcgcaaaagatg

SEQ ID NO: 240372 - DNA, 103 bp, Artificial Sequence
  Synthetic Polynucleotide
taatacgactcactatagggttttgtgatccttgaagccgcgccattctcaacagaggagagagaatatggcggcttcaaacctggcggcagcgcaaaagatg

SEQ ID NO: 240373 - DNA, 103 bp, Artificial Sequence
  Synthetic Polynucleotide
taatacgactcactatagggccttttcaccttttgtgatccttgaagccgaacagaggagacggcttatgggatcacaaaacctggcggcagcgcaaaagatg

SEQ ID NO: 240374 - DNA, 103 bp, Artificial Sequence
  Synthetic Polynucleotide
taatacgactcactatagggcaggctgggcccttttcaccttttgtgatcaacagaggagagatcacatgaggtgaaaaaacctggcggcagcgcaaaagatg

SEQ ID NO: 240375 - DNA, 103 bp, Artificial Sequence
  Synthetic Polynucleotide
taatacgactcactatagggcccggagtacagggacaaggtgtctaagttaacagaggagaaacttaatgaccttgtccaacctggcggcagcgcaaaagatg

SEQ ID NO: 240376 - DNA, 103 bp, Artificial Sequence
  Synthetic Polynucleotide
taatacgactcactatagggaccccgggagcaggctgggcccttttcaccaacagaggagaggtgaaatgggcccagccaacctggcggcagcgcaaaagatg

SEQ ID NO: 240377 - DNA, 103 bp, Artificial Sequence
  Synthetic Polynucleotide
taatacgactcactatagggggtagcctccaccccgggagcaggctgggcaacagaggagagcccagatggctcccgggaacctggcggcagcgcaaaagatg

SEQ ID NO: 240378 - DNA, 103 bp, Artificial Sequence
  Synthetic Polynucleotide
taatacgactcactatagggcccaagagccggtagcctccaccccgggagaacagaggagactcccgatgtggaggctaaacctggcggcagcgcaaaagatg

SEQ ID NO: 240379 - DNA, 103 bp, Artificial Sequence
  Synthetic Polynucleotide
taatacgactcactatagggcctggggttgcccaagagccggtagcctccaacagaggagaggaggcatgcggctcttgaacctggcggcagcgcaaaagatg

SEQ ID NO: 240380 - DNA, 103 bp, Artificial Sequence
  Synthetic Polynucleotide
taatacgactcactatagggatcgcggggccctggggttgcccaagagccaacagaggagaggctctatggcaaccccaaacctggcggcagcgcaaaagatg

SEQ ID NO: 240381 - DNA, 103 bp, Artificial Sequence
  Synthetic Polynucleotide
taatacgactcactatagggaagccggagaatcgcggggccctggggttgaacagaggagacaacccatgggccccgcgaacctggcggcagcgcaaaagatg

SEQ ID NO: 240382 - DNA, 103 bp, Artificial Sequence
  Synthetic Polynucleotide
taatacgactcactatagggctctttccggaagccggagaatcgcggggcaacagaggagagccccgatgttctccggcaacctggcggcagcgcaaaagatg

SEQ ID NO: 240383 - DNA, 103 bp, Artificial Sequence
  Synthetic Polynucleotide
taatacgactcactatagggtcttcgccttctctttccggaagccggagaaacagaggagatctccgatgtccggaaagaacctggcggcagcgcaaaagatg

SEQ ID NO: 240384 - DNA, 103 bp, Artificial Sequence
  Synthetic Polynucleotide
taatacgactcactatagggcacatatccatcttcgccttctctttccggaacagaggagaccggaaatggaaggcgaaaacctggcggcagcgcaaaagatg

SEQ ID NO: 240385 - DNA, 103 bp, Artificial Sequence
  Synthetic Polynucleotide
taatacgactcactatagggagccgcacagcacatatccatcttcgccttaacagaggagaaaggcgatgatggatatgaacctggcggcagcgcaaaagatg

SEQ ID NO: 240386 - DNA, 103 bp, Artificial Sequence
  Synthetic Polynucleotide
taatacgactcactatagggcactgtccttcccggagtacagggacaaggaacagaggagaccttgtatgtgtactccgaacctggcggcagcgcaaaagatg

SEQ ID NO: 240387 - DNA, 103 bp, Artificial Sequence
  Synthetic Polynucleotide
taatacgactcactatagggggctcggagaagccgcacagcacatatccaaacagaggagatggataatggctgtgcggaacctggcggcagcgcaaaagatg

SEQ ID NO: 240388 - DNA, 103 bp, Artificial Sequence
  Synthetic Polynucleotide
taatacgactcactatagggatggctacctggctcggagaagccgcacagaacagaggagactgtgcatgttctccgagaacctggcggcagcgcaaaagatg

SEQ ID NO: 240389 - DNA, 103 bp, Artificial Sequence
  Synthetic Polynucleotide
taatacgactcactataggggaaggaggccatggctacctggctcggagaaacagaggagatctccgatgcaggtagccaacctggcggcagcgcaaaagatg

SEQ ID NO: 240390 - DNA, 103 bp, Artificial Sequence
  Synthetic Polynucleotide
taatacgactcactatagggcggccgatgagaaggaggccatggctacctaacagaggagaaggtagatgtggcctcctaacctggcggcagcgcaaaagatg

SEQ ID NO: 240391 - DNA, 103 bp, Artificial Sequence
  Synthetic Polynucleotide
taatacgactcactataggggccgggggcccggccgatgagaaggaggccaacagaggagaggcctcatgctcatcggcaacctggcggcagcgcaaaagatg

SEQ ID NO: 240392 - DNA, 103 bp, Artificial Sequence
  Synthetic Polynucleotide
taatacgactcactatagggggagggatctgccgggggcccggccgatgaaacagaggagatcatcgatggggcccccgaacctggcggcagcgcaaaagatg

SEQ ID NO: 240393 - DNA, 103 bp, Artificial Sequence
  Synthetic Polynucleotide
taatacgactcactataggggcttggacttggagggatctgccgggggccaacagaggagaggccccatgcagatccctaacctggcggcagcgcaaaagatg

SEQ ID NO: 240394 - DNA, 103 bp, Artificial Sequence
  Synthetic Polynucleotide
taatacgactcactatagggaatattgtcagcttggacttggagggatctaacagaggagaagatccatgcaagtccaaaacctggcggcagcgcaaaagatg

SEQ ID NO: 240395 - DNA, 103 bp, Artificial Sequence
  Synthetic Polynucleotide
taatacgactcactataggggattctgctgaatattgtcagcttggacttaacagaggagaaagtccatgctgacaataaacctggcggcagcgcaaaagatg

SEQ ID NO: 240396 - DNA, 103 bp, Artificial Sequence
  Synthetic Polynucleotide
taatacgactcactatagggttccaccctggattctgctgaatattgtcaaacagaggagatgacaaatgtcagcagaaaacctggcggcagcgcaaaagatg

SEQ ID NO: 240397 - DNA, 103 bp, Artificial Sequence
  Synthetic Polynucleotide
taatacgactcactatagggttcacagaatcactgtccttcccggagtacaacagaggagagtactcatggaaggacagaacctggcggcagcgcaaaagatg

SEQ ID NO: 240398 - DNA, 103 bp, Artificial Sequence
  Synthetic Polynucleotide
taatacgactcactatagggctgtagatgtttccaccctggattctgctgaacagaggagacagcagatgccagggtggaacctggcggcagcgcaaaagatg

SEQ ID NO: 240399 - DNA, 103 bp, Artificial Sequence
  Synthetic Polynucleotide
taatacgactcactatagggatgggggagcctgtagatgtttccaccctgaacagaggagacagggtatgaacatctacaacctggcggcagcgcaaaagatg

SEQ ID NO: 240400 - DNA, 103 bp, Artificial Sequence
  Synthetic Polynucleotide
taatacgactcactatagggccttcaccggatgggggagcctgtagatgtaacagaggagaacatctatgggctcccccaacctggcggcagcgcaaaagatg

SEQ ID NO: 240401 - DNA, 103 bp, Artificial Sequence
  Synthetic Polynucleotide
taatacgactcactatagggacattctcttccttcaccggatgggggagcaacagaggagagctcccatgtccggtgaaaacctggcggcagcgcaaaagatg

SEQ ID NO: 240402 - DNA, 103 bp, Artificial Sequence
  Synthetic Polynucleotide
taatacgactcactatagggtctgcctgccacattctcttccttcaccggaacagaggagaccggtgatggaagagaataacctggcggcagcgcaaaagatg

SEQ ID NO: 240403 - DNA, 103 bp, Artificial Sequence
  Synthetic Polynucleotide
taatacgactcactataggggctggttacctctgcctgccacattctcttaacagaggagaaagagaatgtggcaggcaaacctggcggcagcgcaaaagatg

SEQ ID NO: 240404 - DNA, 103 bp, Artificial Sequence
  Synthetic Polynucleotide
taatacgactcactatagggctgccgttttgctggttacctctgcctgccaacagaggagaggcaggatgaggtaaccaaacctggcggcagcgcaaaagatg

SEQ ID NO: 240405 - DNA, 103 bp, Artificial Sequence
  Synthetic Polynucleotide
taatacgactcactataggggtctgtgggactgccgttttgctggttaccaacagaggagaggtaacatgcaaaacggcaacctggcggcagcgcaaaagatg

SEQ ID NO: 240406 - DNA, 103 bp, Artificial Sequence
  Synthetic Polynucleotide
taatacgactcactataggggcttcgtccagtctgtgggactgccgttttaacagaggagaaaaacgatggtcccacagaacctggcggcagcgcaaaagatg

SEQ ID NO: 240407 - DNA, 103 bp, Artificial Sequence
  Synthetic Polynucleotide
taatacgactcactataggggtgctcctgggcttcgtccagtctgtgggaaacagaggagatcccacatgctggacgaaaacctggcggcagcgcaaaagatg

SEQ ID NO: 240408 - DNA, 103 bp, Artificial Sequence
  Synthetic Polynucleotide
taatacgactcactatagggctccagcagcttcacagaatcactgtccttaacagaggagaaaggacatggattctgtgaacctggcggcagcgcaaaagatg

SEQ ID NO: 240409 - DNA, 103 bp, Artificial Sequence
  Synthetic Polynucleotide
taatacgactcactataggggcagacaaaagtgctcctgggcttcgtccaaacagaggagatggacgatgcccaggagcaacctggcggcagcgcaaaagatg

SEQ ID NO: 240410 - DNA, 103 bp, Artificial Sequence
  Synthetic Polynucleotide
taatacgactcactatagggtgcagttcttgcagacaaaagtgctcctggaacagaggagaccaggaatgcttttgtctaacctggcggcagcgcaaaagatg

SEQ ID NO: 240411 - DNA, 103 bp, Artificial Sequence
  Synthetic Polynucleotide
taatacgactcactatagggaacatctggctgcagttcttgcagacaaaaaacagaggagattttgtatgcaagaactgaacctggcggcagcgcaaaagatg

SEQ ID NO: 240412 - DNA, 103 bp, Artificial Sequence
  Synthetic Polynucleotide
taatacgactcactatagggctccgtataaaacatctggctgcagttcttaacagaggagaaagaacatgagccagatgaacctggcggcagcgcaaaagatg

SEQ ID NO: 240413 - DNA, 103 bp, Artificial Sequence
  Synthetic Polynucleotide
taatacgactcactatagggtcagccctttctccgtataaaacatctggcaacagaggagagccagaatgtttatacggaacctggcggcagcgcaaaagatg

SEQ ID NO: 240414 - DNA, 103 bp, Artificial Sequence
  Synthetic Polynucleotide
taatacgactcactatagggatgtggctgctcagccctttctccgtataaaacagaggagattatacatggaaagggctaacctggcggcagcgcaaaagatg

SEQ ID NO: 240415 - DNA, 103 bp, Artificial Sequence
  Synthetic Polynucleotide
taatacgactcactataggggtgaaaacacatgtggctgctcagccctttaacagaggagaaaagggatgagcagccacaacctggcggcagcgcaaaagatg

SEQ ID NO: 240416 - DNA, 103 bp, Artificial Sequence
  Synthetic Polynucleotide
taatacgactcactatagggactggtcgctgtgaaaacacatgtggctgcaacagaggagagcagccatgtgtgttttcaacctggcggcagcgcaaaagatg

SEQ ID NO: 240417 - DNA, 103 bp, Artificial Sequence
  Synthetic Polynucleotide
taatacgactcactatagggggtgacggccactggtcgctgtgaaaacacaacagaggagagtgtttatgcagcgaccaaacctggcggcagcgcaaaagatg

SEQ ID NO: 240418 - DNA, 103 bp, Artificial Sequence
  Synthetic Polynucleotide
taatacgactcactatagggcttccctcgaggtgacggccactggtcgctaacagaggagaagcgacatgtggccgtcaaacctggcggcagcgcaaaagatg

SEQ ID NO: 240419 - DNA, 103 bp, Artificial Sequence
  Synthetic Polynucleotide
taatacgactcactatagggctgcgtactcctccagcagcttcacagaataacagaggagaattctgatgagctgctggaacctggcggcagcgcaaaagatg

SEQ ID NO: 240420 - DNA, 103 bp, Artificial Sequence
  Synthetic Polynucleotide
taatacgactcactataggggcggttcctgcttccctcgaggtgacggccaacagaggagaggccgtatgctcgagggaaacctggcggcagcgcaaaagatg

SEQ ID NO: 240421 - DNA, 103 bp, Artificial Sequence
  Synthetic Polynucleotide
taatacgactcactatagggccaaacacctgcggttcctgcttccctcgaaacagaggagatcgaggatggcaggaaccaacctggcggcagcgcaaaagatg

SEQ ID NO: 240422 - DNA, 103 bp, Artificial Sequence
  Synthetic Polynucleotide
taatacgactcactatagggaaactctgtgccaaacacctgcggttcctgaacagaggagacaggaaatgcaggtgtttaacctggcggcagcgcaaaagatg

SEQ ID NO: 240423 - DNA, 103 bp, Artificial Sequence
  Synthetic Polynucleotide
taatacgactcactataggggcggcttgcaaaactctgtgccaaacacctaacagaggagaaggtgtatggcacagagtaacctggcggcagcgcaaaagatg

SEQ ID NO: 240424 - DNA, 103 bp, Artificial Sequence
  Synthetic Polynucleotide
taatacgactcactatagggacctgtcttagcggcttgcaaaactctgtgaacagaggagacacagaatgttgcaagccaacctggcggcagcgcaaaagatg

SEQ ID NO: 240425 - DNA, 103 bp, Artificial Sequence
  Synthetic Polynucleotide
taatacgactcactatagggtggcctcagcacctgtcttagcggcttgcaaacagaggagatgcaagatgctaagacagaacctggcggcagcgcaaaagatg

SEQ ID NO: 240426 - DNA, 103 bp, Artificial Sequence
  Synthetic Polynucleotide
taatacgactcactatagggtgtccccttctggcctcagcacctgtcttaaacagaggagataagacatgtgctgaggcaacctggcggcagcgcaaaagatg

SEQ ID NO: 240427 - DNA, 103 bp, Artificial Sequence
  Synthetic Polynucleotide
taatacgactcactatagggggactatgcctgtccccttctggcctcagcaacagaggagagctgagatgagaaggggaaacctggcggcagcgcaaaagatg

SEQ ID NO: 240428 - DNA, 103 bp, Artificial Sequence
  Synthetic Polynucleotide
taatacgactcactatagggggttcctgggggactatgcctgtccccttcaacagaggagagaagggatgaggcatagtaacctggcggcagcgcaaaagatg

SEQ ID NO: 240429 - DNA, 103 bp, Artificial Sequence
  Synthetic Polynucleotide
taatacgactcactatagggagggcttcttggttcctgggggactatgccaacagaggagaggcataatgccccaggaaaacctggcggcagcgcaaaagatg

SEQ ID NO: 240430 - DNA, 103 bp, Artificial Sequence
  Synthetic Polynucleotide
taatacgactcactataggggactccgaatctgcgtactcctccagcagcaacagaggagagctgctatgggagtacgcaacctggcggcagcgcaaaagatg

SEQ ID NO: 240431 - DNA, 103 bp, Artificial Sequence
  Synthetic Polynucleotide
taatacgactcactataggggtggggtccaagggcttcttggttcctgggaacagaggagacccaggatgcaagaagccaacctggcggcagcgcaaaagatg

SEQ ID NO: 240432 - DNA, 103 bp, Artificial Sequence
  Synthetic Polynucleotide
taatacgactcactatagggggctgcagctgtggggtccaagggcttcttaacagaggagaaagaagatgttggaccccaacctggcggcagcgcaaaagatg

SEQ ID NO: 240433 - DNA, 103 bp, Artificial Sequence
  Synthetic Polynucleotide
taatacgactcactatagggccaccaaaggggctgcagctgtggggtccaaacagaggagatggaccatgcagctgcagaacctggcggcagcgcaaaagatg

SEQ ID NO: 240434 - DNA, 103 bp, Artificial Sequence
  Synthetic Polynucleotide
taatacgactcactataggggattgggggaccaccaaaggggctgcagctaacagaggagaagctgcatgccctttggtaacctggcggcagcgcaaaagatg

SEQ ID NO: 240435 - DNA, 103 bp, Artificial Sequence
  Synthetic Polynucleotide
taatacgactcactatagggcacggggatcgattgggggaccaccaaaggaacagaggagacctttgatggtcccccaaaacctggcggcagcgcaaaagatg

SEQ ID NO: 240436 - DNA, 103 bp, Artificial Sequence
  Synthetic Polynucleotide
taatacgactcactatagggtcactggaaccacggggatcgattgggggaaacagaggagatcccccatgcgatccccgaacctggcggcagcgcaaaagatg

SEQ ID NO: 240437 - DNA, 103 bp, Artificial Sequence
  Synthetic Polynucleotide
taatacgactcactatagggatgtgtcgggtcactggaaccacggggatcaacagaggagagatcccatgggttccagtaacctggcggcagcgcaaaagatg

SEQ ID NO: 240438 - DNA, 103 bp, Artificial Sequence
  Synthetic Polynucleotide
taatacgactcactatagggcatgctccctatgtgtcgggtcactggaacaacagaggagagttccaatgacccgacacaacctggcggcagcgcaaaagatg

SEQ ID NO: 240439 - DNA, 103 bp, Artificial Sequence
  Synthetic Polynucleotide
taatacgactcactataggggtcccatggccatgctccctatgtgtcgggaacagaggagacccgacatgtagggagcaaacctggcggcagcgcaaaagatg

SEQ ID NO: 240440 - DNA, 103 bp, Artificial Sequence
  Synthetic Polynucleotide
taatacgactcactatagggtctttctcttgtcccatggccatgctccctaacagaggagaagggagatgggccatgggaacctggcggcagcgcaaaagatg

SEQ ID NO: 240441 - DNA, 103 bp, Artificial Sequence
  Synthetic Polynucleotide
taatacgactcactatagggggatgcctgagactccgaatctgcgtactcaacagaggagagagtacatggattcggagaacctggcggcagcgcaaaagatg

SEQ ID NO: 240442 - DNA, 103 bp, Artificial Sequence
  Synthetic Polynucleotide
taatacgactcactatagggctcctccccgtctttctcttgtcccatggcaacagaggagagccatgatgcaagagaaaaacctggcggcagcgcaaaagatg

SEQ ID NO: 240443 - DNA, 103 bp, Artificial Sequence
  Synthetic Polynucleotide
taatacgactcactatagggtgctgtctcgctcctccccgtctttctcttaacagaggagaaagagaatgacggggaggaacctggcggcagcgcaaaagatg

SEQ ID NO: 240444 - DNA, 103 bp, Artificial Sequence
  Synthetic Polynucleotide
taatacgactcactatagggctgctctccttgctgtctcgctcctccccgaacagaggagacggggaatggcgagacagaacctggcggcagcgcaaaagatg

SEQ ID NO: 240445 - DNA, 103 bp, Artificial Sequence
  Synthetic Polynucleotide
taatacgactcactatagggtctctgctggctgctctccttgctgtctcgaacagaggagacgagacatgaaggagagcaacctggcggcagcgcaaaagatg

SEQ ID NO: 240446 - DNA, 103 bp, Artificial Sequence
  Synthetic Polynucleotide
taatacgactcactatagggtcttccgctttctctgctggctgctctcctaacagaggagaaggagaatggccagcagaaacctggcggcagcgcaaaagatg

SEQ ID NO: 240447 - DNA, 103 bp, Artificial Sequence
  Synthetic Polynucleotide
taatacgactcactataggggggggccgcttcttccgctttctctgctggaacagaggagaccagcaatgaaagcggaaaacctggcggcagcgcaaaagatg

SEQ ID NO: 240448 - DNA, 103 bp, Artificial Sequence
  Synthetic Polynucleotide
taatacgactcactatagggcgtggagggtgggggccgcttcttccgcttaacagaggagaaagcggatgaagcggcccaacctggcggcagcgcaaaagatg

SEQ ID NO: 240449 - DNA, 103 bp, Artificial Sequence
  Synthetic Polynucleotide
taatacgactcactataggggctccccagccgtggagggtgggggccgctaacagaggagaagcggcatgcaccctccaaacctggcggcagcgcaaaagatg

SEQ ID NO: 240450 - DNA, 103 bp, Artificial Sequence
  Synthetic Polynucleotide
taatacgactcactataggggcagggccaggctccccagccgtggagggtaacagaggagaaccctcatgggctggggaaacctggcggcagcgcaaaagatg

SEQ ID NO: 240451 - DNA, 103 bp, Artificial Sequence
  Synthetic Polynucleotide
taatacgactcactataggggtggcatcctgcagggccaggctccccagcaacagaggagagctgggatgcctggccctaacctggcggcagcgcaaaagatg

SEQ ID NO: 240452 - DNA, 103 bp, Artificial Sequence
  Synthetic Polynucleotide
taatacgactcactatagggggtcttgtaaggatgcctgagactccgaataacagaggagaattcggatgctcaggcataacctggcggcagcgcaaaagatg

SEQ ID NO: 240453 - DNA, 103 bp, Artificial Sequence
  Synthetic Polynucleotide
taatacgactcactatagggggcggctctggtggcatcctgcagggccagaacagaggagactggccatgcaggatgccaacctggcggcagcgcaaaagatg

SEQ ID NO: 240454 - DNA, 103 bp, Artificial Sequence
  Synthetic Polynucleotide
taatacgactcactatagggggtgaccgcaggcggctctggtggcatcctaacagaggagaaggatgatgccagagccgaacctggcggcagcgcaaaagatg

SEQ ID NO: 240455 - DNA, 103 bp, Artificial Sequence
  Synthetic Polynucleotide
taatacgactcactatagggcaggaacatgggtgaccgcaggcggctctgaacagaggagacagagcatgctgcggtcaaacctggcggcagcgcaaaagatg

SEQ ID NO: 240456 - DNA, 103 bp, Artificial Sequence
  Synthetic Polynucleotide
taatacgactcactatagggggcagtccaccaggaacatgggtgaccgcaaacagaggagatgcggtatgccatgttccaacctggcggcagcgcaaaagatg

SEQ ID NO: 240457 - DNA, 103 bp, Artificial Sequence
  Synthetic Polynucleotide
taatacgactcactatagggcccttcaggaggcagtccaccaggaacatgaacagaggagacatgttatgggtggactgaacctggcggcagcgcaaaagatg

SEQ ID NO: 240458 - DNA, 103 bp, Artificial Sequence
  Synthetic Polynucleotide
taatacgactcactatagggctggaataagcccttcaggaggcagtccacaacagaggagagtggacatgctcctgaagaacctggcggcagcgcaaaagatg

SEQ ID NO: 240459 - DNA, 103 bp, Artificial Sequence
  Synthetic Polynucleotide
taatacgactcactatagggagggggagcactggaataagcccttcaggaaacagaggagatcctgaatggcttattccaacctggcggcagcgcaaaagatg

SEQ ID NO: 240460 - DNA, 103 bp, Artificial Sequence
  Synthetic Polynucleotide
taatacgactcactatagggggtggtgtgtagggggagcactggaataagaacagaggagacttattatggtgctccccaacctggcggcagcgcaaaagatg

SEQ ID NO: 240461 - DNA, 103 bp, Artificial Sequence
  Synthetic Polynucleotide
taatacgactcactataggggagcattgggggtggtgtgtagggggagcaaacagaggagatgctccatgtacacaccaaacctggcggcagcgcaaaagatg

SEQ ID NO: 240462 - DNA, 103 bp, Artificial Sequence
  Synthetic Polynucleotide
taatacgactcactatagggggatggggctgagcattgggggtggtgtgtaacagaggagaacacacatgccccaatgcaacctggcggcagcgcaaaagatg

SEQ ID NO: 240463 - DNA, 103 bp, Artificial Sequence
  Synthetic Polynucleotide
taatacgactcactatagggtgcatttctgatgggagggcaccctcgtctaacagaggagaagacgaatgtgccctcccaacctggcggcagcgcaaaagatg

SEQ ID NO: 240464 - DNA, 103 bp, Artificial Sequence
  Synthetic Polynucleotide
taatacgactcactatagggcctagccccaggtcttgtaaggatgcctgaaacagaggagatcaggcatgcttacaagaaacctggcggcagcgcaaaagatg

SEQ ID NO: 240465 - DNA, 103 bp, Artificial Sequence
  Synthetic Polynucleotide
taatacgactcactataggggagccctcccggatggggctgagcattgggaacagaggagacccaatatgcagccccataacctggcggcagcgcaaaagatg

SEQ ID NO: 240466 - DNA, 103 bp, Artificial Sequence
  Synthetic Polynucleotide
taatacgactcactataggggtacaccccagagccctcccggatggggctaacagaggagaagccccatgcgggagggcaacctggcggcagcgcaaaagatg

SEQ ID NO: 240467 - DNA, 103 bp, Artificial Sequence
  Synthetic Polynucleotide
taatacgactcactataggggggtgttgaagtacaccccagagccctcccaacagaggagagggaggatgctggggtgtaacctggcggcagcgcaaaagatg

SEQ ID NO: 240468 - DNA, 103 bp, Artificial Sequence
  Synthetic Polynucleotide
taatacgactcactataggggtggaacagagggtgttgaagtacaccccaaacagaggagatggggtatgcttcaacacaacctggcggcagcgcaaaagatg

SEQ ID NO: 240469 - DNA, 103 bp, Artificial Sequence
  Synthetic Polynucleotide
taatacgactcactatagggctgagtggacgtggaacagagggtgttgaaaacagaggagattcaacatgctctgttccaacctggcggcagcgcaaaagatg

SEQ ID NO: 240470 - DNA, 103 bp, Artificial Sequence
  Synthetic Polynucleotide
taatacgactcactatagggcagggctggcctgagtggacgtggaacagaaacagaggagatctgttatgcgtccactcaacctggcggcagcgcaaaagatg

SEQ ID NO: 240471 - DNA, 103 bp, Artificial Sequence
  Synthetic Polynucleotide
taatacgactcactatagggatgagctggtcagggctggcctgagtggacaacagaggagagtccacatgggccagcccaacctggcggcagcgcaaaagatg

SEQ ID NO: 240472 - DNA, 103 bp, Artificial Sequence
  Synthetic Polynucleotide
taatacgactcactatagggcatggagctgatgagctggtcagggctggcaacagaggagagccagcatggaccagctcaacctggcggcagcgcaaaagatg

SEQ ID NO: 240473 - DNA, 103 bp, Artificial Sequence
  Synthetic Polynucleotide
taatacgactcactatagggcttgatcgagcatggagctgatgagctggtaacagaggagaaccagcatgtcagctccaaacctggcggcagcgcaaaagatg

SEQ ID NO: 240474 - DNA, 103 bp, Artificial Sequence
  Synthetic Polynucleotide
taatacgactcactataggggacccatccacttgatcgagcatggagctgaacagaggagacagctcatggctcgatcaaacctggcggcagcgcaaaagatg

SEQ ID NO: 240475 - DNA, 103 bp, Artificial Sequence
  Synthetic Polynucleotide
taatacgactcactatagggcttaagcacacctagccccaggtcttgtaaaacagaggagattacaaatgctggggctaaacctggcggcagcgcaaaagatg

SEQ ID NO: 240476 - DNA, 103 bp, Artificial Sequence
  Synthetic Polynucleotide
taatacgactcactataggggatgccaaaggacccatccacttgatcgagaacagaggagactcgatatggtggatgggaacctggcggcagcgcaaaagatg

SEQ ID NO: 240477 - DNA, 103 bp, Artificial Sequence
  Synthetic Polynucleotide
taatacgactcactatagggtcaccacacagatgccaaaggacccatccaaacagaggagatggatgatgcctttggcaaacctggcggcagcgcaaaagatg

SEQ ID NO: 240478 - DNA, 103 bp, Artificial Sequence
  Synthetic Polynucleotide
taatacgactcactataggggtgtcatccttcaccacacagatgccaaagaacagaggagactttggatgctgtgtggtaacctggcggcagcgcaaaagatg

SEQ ID NO: 240479 - DNA, 103 bp, Artificial Sequence
  Synthetic Polynucleotide
taatacgactcactataggggctgattttggtgtcatccttcaccacacaaacagaggagatgtgtgatgaaggatgacaacctggcggcagcgcaaaagatg

SEQ ID NO: 240480 - DNA, 103 bp, Artificial Sequence
  Synthetic Polynucleotide
taatacgactcactataggggtggctcaatgctgattttggtgtcatcctaacagaggagaaggatgatgccaaaatcaaacctggcggcagcgcaaaagatg

SEQ ID NO: 240481 - DNA, 103 bp, Artificial Sequence
  Synthetic Polynucleotide
taatacgactcactatagggatattgatatgtggctcaatgctgattttgaacagaggagacaaaatatgcattgagccaacctggcggcagcgcaaaagatg

SEQ ID NO: 240482 - DNA, 103 bp, Artificial Sequence
  Synthetic Polynucleotide
taatacgactcactatagggccggcttcctatattgatatgtggctcaataacagaggagaattgagatgcatatcaataacctggcggcagcgcaaaagatg

SEQ ID NO: 240483 - DNA, 103 bp, Artificial Sequence
  Synthetic Polynucleotide
taatacgactcactatagggctgcctgaaaccggcttcctatattgatataacagaggagaatatcaatgtaggaagccaacctggcggcagcgcaaaagatg

SEQ ID NO: 240484 - DNA, 103 bp, Artificial Sequence
  Synthetic Polynucleotide
taatacgactcactatagggtccgggatctctgcctgaaaccggcttcctaacagaggagaaggaagatggtttcaggcaacctggcggcagcgcaaaagatg

SEQ ID NO: 240485 - DNA, 103 bp, Artificial Sequence
  Synthetic Polynucleotide
taatacgactcactatagggctcctggagttccgggatctctgcctgaaaaacagaggagatttcagatggagatcccgaacctggcggcagcgcaaaagatg

SEQ ID NO: 240486 - DNA, 103 bp, Artificial Sequence
  Synthetic Polynucleotide
taatacgactcactatagggcctctttagccttaagcacacctagccccaaacagaggagatggggcatggtgtgcttaaacctggcggcagcgcaaaagatg

SEQ ID NO: 240487 - DNA, 103 bp, Artificial Sequence
  Synthetic Polynucleotide
taatacgactcactatagggccagggatctctcctggagttccgggatctaacagaggagaagatccatgaactccaggaacctggcggcagcgcaaaagatg

SEQ ID NO: 240488 - DNA, 103 bp, Artificial Sequence
  Synthetic Polynucleotide
taatacgactcactatagggtcagttccagccagggatctctcctggagtaacagaggagaactccaatggagatccctaacctggcggcagcgcaaaagatg

SEQ ID NO: 240489 - DNA, 103 bp, Artificial Sequence
  Synthetic Polynucleotide
taatacgactcactatagggtacatgctcgtcagttccagccagggatctaacagaggagaagatccatggctggaactaacctggcggcagcgcaaaagatg

SEQ ID NO: 240490 - DNA, 103 bp, Artificial Sequence
  Synthetic Polynucleotide
taatacgactcactatagggccagagaagctacatgctcgtcagttccagaacagaggagactggaaatgacgagcatgaacctggcggcagcgcaaaagatg

SEQ ID NO: 240491 - DNA, 103 bp, Artificial Sequence
  Synthetic Polynucleotide
taatacgactcactatagggggcttccagaccagagaagctacatgctcgaacagaggagacgagcaatgagcttctctaacctggcggcagcgcaaaagatg

SEQ ID NO: 240492 - DNA, 103 bp, Artificial Sequence
  Synthetic Polynucleotide
taatacgactcactatagggatctccccatggcttccagaccagagaagcaacagaggagagcttctatggtctggaagaacctggcggcagcgcaaaagatg

SEQ ID NO: 240493 - DNA, 103 bp, Artificial Sequence
  Synthetic Polynucleotide
taatacgactcactatagggtgatcatcatatctccccatggcttccagaaacagaggagatctggaatgcatggggagaacctggcggcagcgcaaaagatg

SEQ ID NO: 240494 - DNA, 103 bp, Artificial Sequence
  Synthetic Polynucleotide
taatacgactcactataggggtctctgagctgatcatcatatctccccataacagaggagaatggggatgtatgatgataacctggcggcagcgcaaaagatg

SEQ ID NO: 240495 - DNA, 103 bp, Artificial Sequence
  Synthetic Polynucleotide
taatacgactcactatagggtctatcctgtgtctctgagctgatcatcataacagaggagaatgatgatgagctcagagaacctggcggcagcgcaaaagatg

SEQ ID NO: 240496 - DNA, 103 bp, Artificial Sequence
  Synthetic Polynucleotide
taatacgactcactataggggctcggtcactctatcctgtgtctctgagcaacagaggagagctcagatgcacaggataaacctggcggcagcgcaaaagatg

SEQ ID NO: 240497 - DNA, 103 bp, Artificial Sequence
  Synthetic Polynucleotide
taatacgactcactatagggccttcgtcagcctctttagccttaagcacaaacagaggagatgtgctatgggctaaagaaacctggcggcagcgcaaaagatg

SEQ ID NO: 240498 - DNA, 103 bp, Artificial Sequence
  Synthetic Polynucleotide
taatacgactcactatagggacattgcagagctcggtcactctatcctgtaacagaggagaacaggaatgagtgaccgaaacctggcggcagcgcaaaagatg

SEQ ID NO: 240499 - DNA, 103 bp, Artificial Sequence
  Synthetic Polynucleotide
taatacgactcactatagggggagcatgccacattgcagagctcggtcacaacagaggagagtgaccatgctctgcaataacctggcggcagcgcaaaagatg

SEQ ID NO: 240500 - DNA, 103 bp, Artificial Sequence
  Synthetic Polynucleotide
taatacgactcactataggggcatcacgctggagcatgccacattgcagaaacagaggagatctgcaatgtggcatgctaacctggcggcagcgcaaaagatg

SEQ ID NO: 240501 - DNA, 103 bp, Artificial Sequence
  Synthetic Polynucleotide
taatacgactcactatagggccccctcctggcatcacgctggagcatgccaacagaggagaggcatgatgcagcgtgataacctggcggcagcgcaaaagatg

SEQ ID NO: 240502 - DNA, 103 bp, Artificial Sequence
  Synthetic Polynucleotide
taatacgactcactatagggcaggttggtgccccctcctggcatcacgctaacagaggagaagcgtgatgccaggagggaacctggcggcagcgcaaaagatg

SEQ ID NO: 240503 - DNA, 103 bp, Artificial Sequence
  Synthetic Polynucleotide
taatacgactcactataggggagcgagctccaggttggtgccccctcctgaacagaggagacaggagatggcaccaaccaacctggcggcagcgcaaaagatg

SEQ ID NO: 240504 - DNA, 103 bp, Artificial Sequence
  Synthetic Polynucleotide
taatacgactcactatagggaggcagtgcagagcgagctccaggttggtgaacagaggagacaccaaatgggagctcgcaacctggcggcagcgcaaaagatg

SEQ ID NO: 240505 - DNA, 103 bp, Artificial Sequence
  Synthetic Polynucleotide
taatacgactcactatagggagcctcgtgcaggcagtgcagagcgagctcaacagaggagagagctcatgctgcactgcaacctggcggcagcgcaaaagatg

SEQ ID NO: 240506 - DNA, 103 bp, Artificial Sequence
  Synthetic Polynucleotide
taatacgactcactatagggcgttgccctgagcctcgtgcaggcagtgcaaacagaggagatgcactatgtgcacgaggaacctggcggcagcgcaaaagatg

SEQ ID NO: 240507 - DNA, 103 bp, Artificial Sequence
  Synthetic Polynucleotide
taatacgactcactataggggcgacctgaacgttgccctgagcctcgtgcaacagaggagagcacgaatgtcagggcaaaacctggcggcagcgcaaaagatg

SEQ ID NO: 240508 - DNA, 103 bp, Artificial Sequence
  Synthetic Polynucleotide
taatacgactcactatagggggcccttcctccttcgtcagcctctttagcaacagaggagagctaaaatggctgacgaaaacctggcggcagcgcaaaagatg

SEQ ID NO: 240509 - DNA, 103 bp, Artificial Sequence
  Synthetic Polynucleotide
taatacgactcactatagggagtctccagggcgacctgaacgttgccctgaacagaggagacagggcatggttcaggtcaacctggcggcagcgcaaaagatg

SEQ ID NO: 240510 - DNA, 103 bp, Artificial Sequence
  Synthetic Polynucleotide
taatacgactcactatagggggagcagaagagtctccagggcgacctgaaaacagaggagattcaggatgccctggagaaacctggcggcagcgcaaaagatg

SEQ ID NO: 240511 - DNA, 103 bp, Artificial Sequence
  Synthetic Polynucleotide
taatacgactcactatagggtggggccctcggagcagaagagtctccaggaacagaggagacctggaatgtcttctgctaacctggcggcagcgcaaaagatg

SEQ ID NO: 240512 - DNA, 103 bp, Artificial Sequence
  Synthetic Polynucleotide
taatacgactcactatagggccgtggcttgtggggccctcggagcagaagaacagaggagacttctgatgcgagggcccaacctggcggcagcgcaaaagatg

SEQ ID NO: 240513 - DNA, 103 bp, Artificial Sequence
  Synthetic Polynucleotide
taatacgactcactataggggcaggtgtgtccgtggcttgtggggccctcaacagaggagagagggcatgacaagccacaacctggcggcagcgcaaaagatg

SEQ ID NO: 240514 - DNA, 103 bp, Artificial Sequence
  Synthetic Polynucleotide
taatacgactcactatagggtagtcagcgagcaggtgtgtccgtggcttgaacagaggagacaagccatggacacacctaacctggcggcagcgcaaaagatg

SEQ ID NO: 240515 - DNA, 103 bp, Artificial Sequence
  Synthetic Polynucleotide
taatacgactcactatagggtgtgtagcgatagtcagcgagcaggtgtgtaacagaggagaacacacatgctcgctgacaacctggcggcagcgcaaaagatg

SEQ ID NO: 240516 - DNA, 103 bp, Artificial Sequence
  Synthetic Polynucleotide
taatacgactcactatagggcgtctgaacctgtgtagcgatagtcagcgaaacagaggagatcgctgatgatcgctacaaacctggcggcagcgcaaaagatg

SEQ ID NO: 240517 - DNA, 103 bp, Artificial Sequence
  Synthetic Polynucleotide
taatacgactcactatagggggggtccagacgtctgaacctgtgtagcgaaacagaggagatcgctaatgaggttcagaaacctggcggcagcgcaaaagatg

SEQ ID NO: 240518 - DNA, 103 bp, Artificial Sequence
  Synthetic Polynucleotide
taatacgactcactatagggcttctctataggggtccagacgtctgaaccaacagaggagaggttcaatggtctggaccaacctggcggcagcgcaaaagatg

SEQ ID NO: 240519 - DNA, 103 bp, Artificial Sequence
  Synthetic Polynucleotide
taatacgactcactatagggtccccgaggtggcccttcctccttcgtcagaacagaggagactgacgatggaggaagggaacctggcggcagcgcaaaagatg

SEQ ID NO: 240520 - DNA, 103 bp, Artificial Sequence
  Synthetic Polynucleotide
taatacgactcactatagggtaaaaagcctcttctctataggggtccagaaacagaggagatctggaatgctatagagaaacctggcggcagcgcaaaagatg

SEQ ID NO: 240521 - DNA, 103 bp, Artificial Sequence
  Synthetic Polynucleotide
taatacgactcactatagggaacgccttcttaaaaagcctcttctctataaacagaggagatatagaatggaggcttttaacctggcggcagcgcaaaagatg

SEQ ID NO: 240522 - DNA, 103 bp, Artificial Sequence
  Synthetic Polynucleotide
taatacgactcactataggggtgggcatagaacgccttcttaaaaagcctaacagaggagaaggcttatgaagaaggcgaacctggcggcagcgcaaaagatg

SEQ ID NO: 240523 - DNA, 103 bp, Artificial Sequence
  Synthetic Polynucleotide
taatacgactcactatagggagtccttcttgtgggcatagaacgccttctaacagaggagaagaaggatgtctatgcccaacctggcggcagcgcaaaagatg

SEQ ID NO: 240524 - DNA, 103 bp, Artificial Sequence
  Synthetic Polynucleotide
taatacgactcactatagggatcaagtagaagtccttcttgtgggcatagaacagaggagactatgcatgcaagaaggaaacctggcggcagcgcaaaagatg

SEQ ID NO: 240525 - DNA, 103 bp, Artificial Sequence
  Synthetic Polynucleotide
taatacgactcactatagggcatcttgtgtatcaagtagaagtccttcttaacagaggagaaagaagatgttctacttgaacctggcggcagcgcaaaagatg

SEQ ID NO: 240526 - DNA, 103 bp, Artificial Sequence
  Synthetic Polynucleotide
taatacgactcactatagggttgtctggatcatcttgtgtatcaagtagaaacagaggagatctactatgtacacaagaaacctggcggcagcgcaaaagatg

SEQ ID NO: 240527 - DNA, 103 bp, Artificial Sequence
  Synthetic Polynucleotide
taatacgactcactataggggctaccgtctttgtctggatcatcttgtgtaacagaggagaacacaaatggatccagacaacctggcggcagcgcaaaagatg

SEQ ID NO: 240528 - DNA, 103 bp, Artificial Sequence
  Synthetic Polynucleotide
taatacgactcactatagggaacgcactgagctaccgtctttgtctggataacagaggagaatccagatgaagacggtaaacctggcggcagcgcaaaagatg

SEQ ID NO: 240529 - DNA, 103 bp, Artificial Sequence
  Synthetic Polynucleotide
taatacgactcactatagggaataatactcaacgcactgagctaccgtctaacagaggagaagacggatgctcagtgcgaacctggcggcagcgcaaaagatg

SEQ ID NO: 240530 - DNA, 103 bp, Artificial Sequence
  Synthetic Polynucleotide
taatacgactcactatagggttcctggcactccccgaggtggcccttcctaacagaggagaaggaagatgcacctcgggaacctggcggcagcgcaaaagatg

SEQ ID NO: 240531 - DNA, 103 bp, Artificial Sequence
  Synthetic Polynucleotide
taatacgactcactatagggttccagatgtaataatactcaacgcactgaaacagaggagatcagtgatgtgagtattaaacctggcggcagcgcaaaagatg

SEQ ID NO: 240532 - DNA, 103 bp, Artificial Sequence
  Synthetic Polynucleotide
taatacgactcactataggggatcatttttttccagatgtaataatactcaacagaggagagagtatatgtacatctggaacctggcggcagcgcaaaagatg

SEQ ID NO: 240533 - DNA, 103 bp, Artificial Sequence
  Synthetic Polynucleotide
taatacgactcactatagggagtcaaacttgatcatttttttccagatgtaacagaggagaacatctatgaaaaaatgaaacctggcggcagcgcaaaagatg

SEQ ID NO: 240534 - DNA, 103 bp, Artificial Sequence
  Synthetic Polynucleotide
taatacgactcactataggggctcggccacagtcaaacttgatcatttttaacagaggagaaaaaatatgcaagtttgaaacctggcggcagcgcaaaagatg

SEQ ID NO: 240535 - DNA, 103 bp, Artificial Sequence
  Synthetic Polynucleotide
taatacgactcactatagggtagccctggggctcggccacagtcaaacttaacagaggagaaagtttatgtgtggccgaaacctggcggcagcgcaaaagatg

SEQ ID NO: 240536 - DNA, 103 bp, Artificial Sequence
  Synthetic Polynucleotide
taatacgactcactatagggccctcttttctagccctggggctcggccacaacagaggagagtggccatgccccagggcaacctggcggcagcgcaaaagatg

SEQ ID NO: 240537 - DNA, 103 bp, Artificial Sequence
  Synthetic Polynucleotide
taatacgactcactatagggtctctcttgaccctcttttctagccctgggaacagaggagacccaggatgagaaaagagaacctggcggcagcgcaaaagatg

SEQ ID NO: 240538 - DNA, 103 bp, Artificial Sequence
  Synthetic Polynucleotide
taatacgactcactatagggttcctccggctctctcttgaccctcttttcaacagaggagagaaaagatggtcaagagaaacctggcggcagcgcaaaagatg

SEQ ID NO: 240539 - DNA, 103 bp, Artificial Sequence
  Synthetic Polynucleotide
taatacgactcactatagggtcctttccacttcctccggctctctcttgaaacagaggagatcaagaatgagccggaggaacctggcggcagcgcaaaagatg

SEQ ID NO: 240540 - DNA, 103 bp, Artificial Sequence
  Synthetic Polynucleotide
taatacgactcactatagggttttcctctgtcctttccacttcctccggcaacagaggagagccggaatgagtggaaagaacctggcggcagcgcaaaagatg

SEQ ID NO: 240541 - DNA, 103 bp, Artificial Sequence
  Synthetic Polynucleotide
taatacgactcactatagggccgctttcctttcctggcactccccgaggtaacagaggagaacctcgatgagtgccaggaacctggcggcagcgcaaaagatg

SEQ ID NO: 240542 - DNA, 103 bp, Artificial Sequence
  Synthetic Polynucleotide
taatacgactcactataggggcatgggaccttttcctctgtcctttccacaacagaggagagtggaaatgacagaggaaaacctggcggcagcgcaaaagatg

SEQ ID NO: 240543 - DNA, 103 bp, Artificial Sequence
  Synthetic Polynucleotide
taatacgactcactatagggcccgagggctgcatgggaccttttcctctgaacagaggagacagaggatgaggtcccataacctggcggcagcgcaaaagatg

SEQ ID NO: 240544 - DNA, 103 bp, Artificial Sequence
  Synthetic Polynucleotide
taatacgactcactatagggctgggtctctcccgagggctgcatgggaccaacagaggagaggtcccatgcagccctcgaacctggcggcagcgcaaaagatg

SEQ ID NO: 240545 - DNA, 103 bp, Artificial Sequence
  Synthetic Polynucleotide
taatacgactcactatagggtggatggtggctgggtctctcccgagggctaacagaggagaagccctatggagagacccaacctggcggcagcgcaaaagatg

SEQ ID NO: 240546 - DNA, 103 bp, Artificial Sequence
  Synthetic Polynucleotide
taatacgactcactatagggacttgggagttggatggtggctgggtctctaacagaggagaagagacatggccaccatcaacctggcggcagcgcaaaagatg

SEQ ID NO: 240547 - DNA, 103 bp, Artificial Sequence
  Synthetic Polynucleotide
taatacgactcactatagggttggtctttaacttgggagttggatggtggaacagaggagaccaccaatgaactcccaaaacctggcggcagcgcaaaagatg

SEQ ID NO: 240548 - DNA, 103 bp, Artificial Sequence
  Synthetic Polynucleotide
taatacgactcactatagggcctataactcttggtctttaacttgggagtaacagaggagaactcccatgttaaagaccaacctggcggcagcgcaaaagatg

SEQ ID NO: 240549 - DNA, 103 bp, Artificial Sequence
  Synthetic Polynucleotide
taatacgactcactatagggtggactccctcctataactcttggtctttaaacagaggagataaagaatgagagttataaacctggcggcagcgcaaaagatg

SEQ ID NO: 240550 - DNA, 103 bp, Artificial Sequence
  Synthetic Polynucleotide
taatacgactcactataggggagctgaggatggactccctcctataactcaacagaggagagagttaatggagggagtcaacctggcggcagcgcaaaagatg

SEQ ID NO: 240551 - DNA, 103 bp, Artificial Sequence
  Synthetic Polynucleotide
taatacgactcactatagggatttgggctggagctgaggatggactccctaacagaggagaagggagatgatcctcagcaacctggcggcagcgcaaaagatg

SEQ ID NO: 240552 - DNA, 103 bp, Artificial Sequence
  Synthetic Polynucleotide
taatacgactcactatagggaactgtgctgccgctttcctttcctggcacaacagaggagagtgccaatgaaggaaagcaacctggcggcagcgcaaaagatg

SEQ ID NO: 240553 - DNA, 103 bp, Artificial Sequence
  Synthetic Polynucleotide
taatacgactcactatagggtggagcctgcatttgggctggagctgaggaaacagaggagatcctcaatgccagcccaaaacctggcggcagcgcaaaagatg

SEQ ID NO: 240554 - DNA, 103 bp, Artificial Sequence
  Synthetic Polynucleotide
taatacgactcactatagggggggtccgcttggagcctgcatttgggctgaacagaggagacagcccatgtgcaggctcaacctggcggcagcgcaaaagatg

SEQ ID NO: 240555 - DNA, 103 bp, Artificial Sequence
  Synthetic Polynucleotide
taatacgactcactatagggcaacagctcgggggtccgcttggagcctgcaacagaggagagcaggcatgaagcggaccaacctggcggcagcgcaaaagatg

SEQ ID NO: 240556 - DNA, 103 bp, Artificial Sequence
  Synthetic Polynucleotide
taatacgactcactatagggctgcacttcccaacagctcgggggtccgctaacagaggagaagcggaatgccgagctgtaacctggcggcagcgcaaaagatg

SEQ ID NO: 240557 - DNA, 103 bp, Artificial Sequence
  Synthetic Polynucleotide
taatacgactcactatagggccctggctctctgcacttcccaacagctcgaacagaggagacgagctatggggaagtgcaacctggcggcagcgcaaaagatg

SEQ ID NO: 240558 - DNA, 103 bp, Artificial Sequence
  Synthetic Polynucleotide
taatacgactcactatagggtggaaaaatgccctggctctctgcacttccaacagaggagaggaagtatggagagccagaacctggcggcagcgcaaaagatg

SEQ ID NO: 240559 - DNA, 103 bp, Artificial Sequence
  Synthetic Polynucleotide
taatacgactcactatagggactctctgcatggaaaaatgccctggctctaacagaggagaagagccatggcatttttcaacctggcggcagcgcaaaagatg

SEQ ID NO: 240560 - DNA, 103 bp, Artificial Sequence
  Synthetic Polynucleotide
taatacgactcactatagggaccctttcacactctctgcatggaaaaatgaacagaggagacattttatgatgcagagaaacctggcggcagcgcaaaagatg

SEQ ID NO: 240561 - DNA, 103 bp, Artificial Sequence
  Synthetic Polynucleotide
taatacgactcactatagggcttgtcaaacaccctttcacactctctgcaaacagaggagatgcagaatgtgtgaaaggaacctggcggcagcgcaaaagatg

SEQ ID NO: 240562 - DNA, 103 bp, Artificial Sequence
  Synthetic Polynucleotide
taatacgactcactataggggactcttgatcttgtcaaacaccctttcacaacagaggagagtgaaaatgtgtttgacaaacctggcggcagcgcaaaagatg

SEQ ID NO: 240563 - DNA, 103 bp, Artificial Sequence
  Synthetic Polynucleotide
taatacgactcactatagggttttgaggggaactgtgctgccgctttcctaacagaggagaaggaaaatggcagcacagaacctggcggcagcgcaaaagatg

SEQ ID NO: 240564 - DNA, 103 bp, Artificial Sequence
  Synthetic Polynucleotide
taatacgactcactatagggtgggcatttcgactcttgatcttgtcaaacaacagaggagagtttgaatggatcaagagaacctggcggcagcgcaaaagatg

SEQ ID NO: 240565 - DNA, 103 bp, Artificial Sequence
  Synthetic Polynucleotide
taatacgactcactatagggccgcttcatatgggcatttcgactcttgataacagaggagaatcaagatgcgaaatgccaacctggcggcagcgcaaaagatg

SEQ ID NO: 240566 - DNA, 103 bp, Artificial Sequence
  Synthetic Polynucleotide
taatacgactcactataggggaaggcggtgccgcttcatatgggcatttcaacagaggagagaaatgatgatatgaagcaacctggcggcagcgcaaaagatg

SEQ ID NO: 240567 - DNA, 103 bp, Artificial Sequence
  Synthetic Polynucleotide
taatacgactcactatagggacgtggtcctgaaggcggtgccgcttcataaacagaggagatatgaaatggcaccgcctaacctggcggcagcgcaaaagatg

SEQ ID NO: 240568 - DNA, 103 bp, Artificial Sequence
  Synthetic Polynucleotide
taatacgactcactataggggatgggctccacgtggtcctgaaggcggtgaacagaggagacaccgcatgcaggaccacaacctggcggcagcgcaaaagatg

SEQ ID NO: 240569 - DNA, 103 bp, Artificial Sequence
  Synthetic Polynucleotide
taatacgactcactatagggtcaccctgatgatgggctccacgtggtcctaacagaggagaaggaccatgtggagcccaaacctggcggcagcgcaaaagatg

SEQ ID NO: 240570 - DNA, 103 bp, Artificial Sequence
  Synthetic Polynucleotide
taatacgactcactatagggactggccacttcaccctgatgatgggctccaacagaggagaggagccatgcatcagggtaacctggcggcagcgcaaaagatg

SEQ ID NO: 240571 - DNA, 103 bp, Artificial Sequence
  Synthetic Polynucleotide
taatacgactcactataggggaagggcttcactggccacttcaccctgataacagaggagaatcaggatgaagtggccaaacctggcggcagcgcaaaagatg

SEQ ID NO: 240572 - DNA, 103 bp, Artificial Sequence
  Synthetic Polynucleotide
taatacgactcactatagggcctttagctggaagggcttcactggccactaacagaggagaagtggcatgtgaagccctaacctggcggcagcgcaaaagatg

SEQ ID NO: 240573 - DNA, 103 bp, Artificial Sequence
  Synthetic Polynucleotide
taatacgactcactatagggagctcctcttcctttagctggaagggcttcaacagaggagagaagccatgccagctaaaaacctggcggcagcgcaaaagatg

SEQ ID NO: 240574 - DNA, 103 bp, Artificial Sequence
  Synthetic Polynucleotide
taatacgactcactatagggtgaagggaggtgcatttctgatgggagggcaacagaggagagccctcatgtcagaaatgaacctggcggcagcgcaaaagatg

SEQ ID NO: 240575 - DNA, 103 bp, Artificial Sequence
  Synthetic Polynucleotide
taatacgactcactatagggcagaagtgggttttgaggggaactgtgctgaacagaggagacagcacatgtcccctcaaaacctggcggcagcgcaaaagatg

SEQ ID NO: 240576 - DNA, 103 bp, Artificial Sequence
  Synthetic Polynucleotide
taatacgactcactataggggtcagctcccagctcctcttcctttagctgaacagaggagacagctaatggaagaggagaacctggcggcagcgcaaaagatg

SEQ ID NO: 240577 - DNA, 103 bp, Artificial Sequence
  Synthetic Polynucleotide
taatacgactcactataggggggggccgatgtcagctcccagctcctcttaacagaggagaaagaggatgtgggagctgaacctggcggcagcgcaaaagatg

SEQ ID NO: 240578 - DNA, 103 bp, Artificial Sequence
  Synthetic Polynucleotide
taatacgactcactatagggcaccactgcagggggccgatgtcagctcccaacagaggagagggagcatgcatcggcccaacctggcggcagcgcaaaagatg

SEQ ID NO: 240579 - DNA, 103 bp, Artificial Sequence
  Synthetic Polynucleotide
taatacgactcactatagggggctgcagtccagaagtgggttttgaggggaacagaggagacccctcatgacccacttcaacctggcggcagcgcaaaagatg

SEQ ID NO: 240580 - DNA, 103 bp, Artificial Sequence
  Synthetic Polynucleotide
taatacgactcactatagggttcccgcacaggctgcagtccagaagtgggaacagaggagacccactatgggactgcagaacctggcggcagcgcaaaagatg

SEQ ID NO: 240581 - DNA, 103 bp, Artificial Sequence
  Synthetic Polynucleotide
taatacgactcactataggggctgaacaccttcccgcacaggctgcagtcaacagaggagagactgcatgctgtgcgggaacctggcggcagcgcaaaagatg

SEQ ID NO: 240582 - DNA, 103 bp, Artificial Sequence
  Synthetic Polynucleotide
taatacgactcactatagggaactggcgctgctgaacaccttcccgcacaaacagaggagatgtgcgatgaggtgttcaaacctggcggcagcgcaaaagatg

SEQ ID NO: 240583 - DNA, 103 bp, Artificial Sequence
  Synthetic Polynucleotide
taatacgactcactatagggttgctcagagaactggcgctgctgaacaccaacagaggagaggtgttatgcagcgccagaacctggcggcagcgcaaaagatg

SEQ ID NO: 240584 - DNA, 103 bp, Artificial Sequence
  Synthetic Polynucleotide
taatacgactcactatagggcaggtagtgcttgctcagagaactggcgctaacagaggagaagcgccatgtctctgagcaacctggcggcagcgcaaaagatg

SEQ ID NO: 240585 - DNA, 103 bp, Artificial Sequence
  Synthetic Polynucleotide
taatacgactcactatagggggctgtgtgtcaggtagtgcttgctcagagaacagaggagactctgaatgagcactaccaacctggcggcagcgcaaaagatg

SEQ ID NO: 240586 - DNA, 103 bp, Artificial Sequence
  Synthetic Polynucleotide
taatacgactcactatagggttcctttcctggctgtgtgtcaggtagtgcaacagaggagagcactaatggacacacagaacctggcggcagcgcaaaagatg

SEQ ID NO: 240587 - DNA, 103 bp, Artificial Sequence
  Synthetic Polynucleotide
taatacgactcactataggggcagacgtgcttcctttcctggctgtgtgtaacagaggagaacacacatgcaggaaaggaacctggcggcagcgcaaaagatg

SEQ ID NO: 240588 - DNA, 103 bp, Artificial Sequence
  Synthetic Polynucleotide
taatacgactcactatagggtctctgaaaatgaagggaggtgcatttctgaacagaggagacagaaaatgacctcccttaacctggcggcagcgcaaaagatg

SEQ ID NO: 240589 - DNA, 103 bp, Artificial Sequence
  Synthetic Polynucleotide
taatacgactcactatagggtgcagattttgcagacgtgcttcctttcctaacagaggagaaggaaaatgagcacgtctaacctggcggcagcgcaaaagatg

SEQ ID NO: 240590 - DNA, 103 bp, Artificial Sequence
  Synthetic Polynucleotide
taatacgactcactatagggaaggccttgctgcagattttgcagacgtgcaacagaggagagcacgtatgcaaaatctgaacctggcggcagcgcaaaagatg

SEQ ID NO: 240591 - DNA, 103 bp, Artificial Sequence
  Synthetic Polynucleotide
taatacgactcactatagggctggcgcttaaaggccttgctgcagattttaacagaggagaaaaatcatgagcaaggccaacctggcggcagcgcaaaagatg

SEQ ID NO: 240592 - DNA, 103 bp, Artificial Sequence
  Synthetic Polynucleotide
taatacgactcactatagggtcaggtggtcctggcgcttaaaggccttgcaacagaggagagcaaggatgttaagcgccaacctggcggcagcgcaaaagatg

SEQ ID NO: 240593 - DNA, 103 bp, Artificial Sequence
  Synthetic Polynucleotide
taatacgactcactatagggatgtgcccggtcaggtggtcctggcgcttaaacagaggagataagcgatgggaccacctaacctggcggcagcgcaaaagatg

SEQ ID NO: 240594 - DNA, 103 bp, Artificial Sequence
  Synthetic Polynucleotide
taatacgactcactataggggtgggtgagcatgtgcccggtcaggtggtcaacagaggagagaccacatgaccgggcacaacctggcggcagcgcaaaagatg

SEQ ID NO: 240595 - DNA, 103 bp, Artificial Sequence
  Synthetic Polynucleotide
taatacgactcactatagggttgtcttctggtgggtgagcatgtgcccggaacagaggagaccgggcatgtgctcacccaacctggcggcagcgcaaaagatg

SEQ ID NO: 240596 - DNA, 103 bp, Artificial Sequence
  Synthetic Polynucleotide
taatacgactcactatagggacgaagggctttgtcttctggtgggtgagcaacagaggagagctcacatgccagaagacaacctggcggcagcgcaaaagatg

SEQ ID NO: 240597 - DNA, 103 bp, Artificial Sequence
  Synthetic Polynucleotide
taatacgactcactatagggctcgatgcacacgaagggctttgtcttctgaacagaggagacagaagatgaagcccttcaacctggcggcagcgcaaaagatg

SEQ ID NO: 240598 - DNA, 103 bp, Artificial Sequence
  Synthetic Polynucleotide
taatacgactcactatagggtgcagccctgctcgatgcacacgaagggctaacagaggagaagccctatgtgtgcatcgaacctggcggcagcgcaaaagatg

SEQ ID NO: 240599 - DNA, 103 bp, Artificial Sequence
  Synthetic Polynucleotide
taatacgactcactatagggagcccttggctctctgaaaatgaagggaggaacagaggagacctcccatgattttcagaaacctggcggcagcgcaaaagatg

SEQ ID NO: 240600 - DNA, 103 bp, Artificial Sequence
  Synthetic Polynucleotide
taatacgactcactatagggtagctcttgctgcagccctgctcgatgcacaacagaggagagtgcatatggcagggctgaacctggcggcagcgcaaaagatg

SEQ ID NO: 240601 - DNA, 103 bp, Artificial Sequence
  Synthetic Polynucleotide
taatacgactcactataggggtagtcgcagtagctcttgctgcagccctgaacagaggagacagggcatgagcaagagcaacctggcggcagcgcaaaagatg

SEQ ID NO: 240602 - DNA, 103 bp, Artificial Sequence
  Synthetic Polynucleotide
taatacgactcactataggggcagagagcggtagtcgcagtagctcttgcaacagaggagagcaagaatgactgcgactaacctggcggcagcgcaaaagatg

SEQ ID NO: 240603 - DNA, 103 bp, Artificial Sequence
  Synthetic Polynucleotide
taatacgactcactatagggtagtgccggcgcagagagcggtagtcgcagaacagaggagactgcgaatgccgctctctaacctggcggcagcgcaaaagatg

SEQ ID NO: 240604 - DNA, 103 bp, Artificial Sequence
  Synthetic Polynucleotide
taatacgactcactatagggatggacctcgtagtgccggcgcagagagcgaacagaggagacgctctatgcgccggcacaacctggcggcagcgcaaaagatg

SEQ ID NO: 240605 - DNA, 103 bp, Artificial Sequence
  Synthetic Polynucleotide
taatacgactcactatagggacaggccgtgatggacctcgtagtgccggcaacagaggagagccggcatgacgaggtccaacctggcggcagcgcaaaagatg

SEQ ID NO: 240606 - DNA, 103 bp, Artificial Sequence
  Synthetic Polynucleotide
taatacgactcactatagggttcaggatgcacaggccgtgatggacctcgaacagaggagacgaggtatgtcacggcctaacctggcggcagcgcaaaagatg

SEQ ID NO: 240607 - DNA, 103 bp, Artificial Sequence
  Synthetic Polynucleotide
taatacgactcactataggggggggcttccttcaggatgcacaggccgtgaacagaggagacacggcatgtgcatcctgaacctggcggcagcgcaaaagatg

SEQ ID NO: 240608 - DNA, 103 bp, Artificial Sequence
  Synthetic Polynucleotide
taatacgactcactatagggcttcctccgggggggcttccttcaggatgcaacagaggagagcatccatgaggaagcccaacctggcggcagcgcaaaagatg

SEQ ID NO: 240609 - DNA, 103 bp, Artificial Sequence
  Synthetic Polynucleotide
taatacgactcactatagggccgcaggcctcttcctccgggggggcttccaacagaggagaggaagcatgcccggaggaaacctggcggcagcgcaaaagatg

SEQ ID NO: 240610 - DNA, 103 bp, Artificial Sequence
  Synthetic Polynucleotide
taatacgactcactataggggctgcagttgagcccttggctctctgaaaaaacagaggagattttcaatgagccaagggaacctggcggcagcgcaaaagatg

SEQ ID NO: 240611 - DNA, 103 bp, Artificial Sequence
  Synthetic Polynucleotide
taatacgactcactataggggggggagtccccgcaggcctcttcctccggaacagaggagaccggagatggaggcctgcaacctggcggcagcgcaaaagatg

SEQ ID NO: 240612 - DNA, 103 bp, Artificial Sequence
  Synthetic Polynucleotide
taatacgactcactatagggcgtgggcgtggggggagtccccgcaggcctaacagaggagaaggcctatggggactcccaacctggcggcagcgcaaaagatg

SEQ ID NO: 240613 - DNA, 103 bp, Artificial Sequence
  Synthetic Polynucleotide
taatacgactcactatagggccggccgactcgtgggcgtggggggagtccaacagaggagaggactcatgccacgcccaaacctggcggcagcgcaaaagatg

SEQ ID NO: 240614 - DNA, 103 bp, Artificial Sequence
  Synthetic Polynucleotide
taatacgactcactataggggggcggctggccggccgactcgtgggcgtgaacagaggagacacgccatggagtcggccaacctggcggcagcgcaaaagatg

SEQ ID NO: 240615 - DNA, 103 bp, Artificial Sequence
  Synthetic Polynucleotide
taatacgactcactatagggggctgctggggggcggctggccggccgactaacagaggagaagtcggatggccagccgcaacctggcggcagcgcaaaagatg

SEQ ID NO: 240616 - DNA, 103 bp, Artificial Sequence
  Synthetic Polynucleotide
taatacgactcactatagggagggaccgcaggctgctggggggcggctggaacagaggagaccagccatgccccagcagaacctggcggcagcgcaaaagatg

SEQ ID NO: 240617 - DNA, 103 bp, Artificial Sequence
  Synthetic Polynucleotide
taatacgactcactatagggtgggggcaccagggaccgcaggctgctgggaacagaggagacccagcatgctgcggtccaacctggcggcagcgcaaaagatg

SEQ ID NO: 240618 - DNA, 103 bp, Artificial Sequence
  Synthetic Polynucleotide
taatacgactcactatagggacctggcctctgggggcaccagggaccgcaaacagaggagatgcggtatgtggtgccccaacctggcggcagcgcaaaagatg

SEQ ID NO: 240619 - DNA, 103 bp, Artificial Sequence
  Synthetic Polynucleotide
taatacgactcactataggggagccgggggacctggcctctgggggcaccaacagaggagaggtgccatgagaggccagaacctggcggcagcgcaaaagatg

SEQ ID NO: 240620 - DNA, 103 bp, Artificial Sequence
  Synthetic Polynucleotide
taatacgactcactataggggggcaggagggagccgggggacctggcctcaacagaggagagaggccatgtcccccggcaacctggcggcagcgcaaaagatg

SEQ ID NO: 240621 - DNA, 103 bp, Artificial Sequence
  Synthetic Polynucleotide
taatacgactcactatagggtgagggtgtcgctgcagttgagcccttggcaacagaggagagccaagatgtcaactgcaaacctggcggcagcgcaaaagatg

SEQ ID NO: 240622 - DNA, 103 bp, Artificial Sequence
  Synthetic Polynucleotide
taatacgactcactatagggggtcccggtggggcaggagggagccgggggaacagaggagacccccgatgccctcctgcaacctggcggcagcgcaaaagatg

SEQ ID NO: 240623 - DNA, 103 bp, Artificial Sequence
  Synthetic Polynucleotide
taatacgactcactatagggcggcgcaggaggtcccggtggggcaggaggaacagaggagacctcctatgccaccgggaaacctggcggcagcgcaaaagatg

SEQ ID NO: 240624 - DNA, 103 bp, Artificial Sequence
  Synthetic Polynucleotide
taatacgactcactatagggactcacgatgcggcgcaggaggtcccggtgaacagaggagacaccggatgctcctgcgcaacctggcggcagcgcaaaagatg

SEQ ID NO: 240625 - DNA, 103 bp, Artificial Sequence
  Synthetic Polynucleotide
taatacgactcactatagggggacgatgctactcacgatgcggcgcaggaaacagaggagatcctgcatggcatcgtgaaacctggcggcagcgcaaaagatg

SEQ ID NO: 240626 - DNA, 103 bp, Artificial Sequence
  Synthetic Polynucleotide
taatacgactcactataggggtcttctggtggacgatgctactcacgatgaacagaggagacatcgtatgtagcatcgtaacctggcggcagcgcaaaagatg

SEQ ID NO: 240627 - DNA, 103 bp, Artificial Sequence
  Synthetic Polynucleotide
taatacgactcactatagggaggagaaggggtcttctggtggacgatgctaacagaggagaagcatcatgcaccagaagaacctggcggcagcgcaaaagatg

SEQ ID NO: 240628 - DNA, 103 bp, Artificial Sequence
  Synthetic Polynucleotide
taatacgactcactataggggggctgggccaggagaaggggtcttctggtaacagaggagaaccagaatgccccttctcaacctggcggcagcgcaaaagatg

SEQ ID NO: 240629 - DNA, 103 bp, Artificial Sequence
  Synthetic Polynucleotide
taatacgactcactataggggcccccgccggggctgggccaggagaagggaacagaggagacccttcatgtggcccagcaacctggcggcagcgcaaaagatg

SEQ ID NO: 240630 - DNA, 103 bp, Artificial Sequence
  Synthetic Polynucleotide
taatacgactcactataggggctgtctgaagcccccgccggggctgggccaacagaggagaggcccaatgccggcggggaacctggcggcagcgcaaaagatg

SEQ ID NO: 240631 - DNA, 103 bp, Artificial Sequence
  Synthetic Polynucleotide
taatacgactcactatagggtcctcccttcgctgtctgaagcccccgccgaacagaggagacggcggatgcttcagacaaacctggcggcagcgcaaaagatg

SEQ ID NO: 240632 - DNA, 103 bp, Artificial Sequence
  Synthetic Polynucleotide
taatacgactcactatagggaaatcccggttgagggtgtcgctgcagttgaacagaggagacaactgatgcgacaccctaacctggcggcagcgcaaaagatg

SEQ ID NO: 240633 - DNA, 103 bp, Artificial Sequence
  Synthetic Polynucleotide
taatacgactcactatagggcaggcagtgttcctcccttcgctgtctgaaaacagaggagattcagaatgcgaagggagaacctggcggcagcgcaaaagatg

SEQ ID NO: 240634 - DNA, 103 bp, Artificial Sequence
  Synthetic Polynucleotide
taatacgactcactatagggggggcagggacaggcagtgttcctcccttcaacagaggagagaagggatgaacactgccaacctggcggcagcgcaaaagatg

SEQ ID NO: 240635 - DNA, 103 bp, Artificial Sequence
  Synthetic Polynucleotide
taatacgactcactatagggccgatgaggcggggcagggacaggcagtgtaacagaggagaacactgatggtccctgccaacctggcggcagcgcaaaagatg

SEQ ID NO: 240636 - DNA, 103 bp, Artificial Sequence
  Synthetic Polynucleotide
taatacgactcactataggggacgaggaccccgatgaggcggggcagggaaacagaggagatccctgatgcgcctcatcaacctggcggcagcgcaaaagatg

SEQ ID NO: 240637 - DNA, 103 bp, Artificial Sequence
  Synthetic Polynucleotide
taatacgactcactatagggtggggtgcaggacgaggaccccgatgaggcaacagaggagagcctcaatggggtcctcgaacctggcggcagcgcaaaagatg

SEQ ID NO: 240638 - DNA, 103 bp, Artificial Sequence
  Synthetic Polynucleotide
taatacgactcactataggggggggccggctggggtgcaggacgaggaccaacagaggagaggtcctatgcctgcacccaacctggcggcagcgcaaaagatg

SEQ ID NO: 240639 - DNA, 103 bp, Artificial Sequence
  Synthetic Polynucleotide
taatacgactcactatagggggggccgcgtgggggccggctggggtgcagaacagaggagactgcacatgagccggcccaacctggcggcagcgcaaaagatg

SEQ ID NO: 240640 - DNA, 103 bp, Artificial Sequence
  Synthetic Polynucleotide
taatacgactcactatagggcagcgctgctggggccgcgtgggggccggcaacagaggagagccggcatgcacgcggccaacctggcggcagcgcaaaagatg

SEQ ID NO: 240641 - DNA, 103 bp, Artificial Sequence
  Synthetic Polynucleotide
taatacgactcactataggggctcggtgtccagcgctgctggggccgcgtaacagaggagaacgcggatgcagcagcgcaacctggcggcagcgcaaaagatg

SEQ ID NO: 240642 - DNA, 103 bp, Artificial Sequence
  Synthetic Polynucleotide
taatacgactcactatagggtcctcgggaagctcggtgtccagcgctgctaacagaggagaagcagcatgggacaccgaaacctggcggcagcgcaaaagatg

SEQ ID NO: 240643 - DNA, 103 bp, Artificial Sequence
  Synthetic Polynucleotide
taatacgactcactatagggagccacatcctcagaggccactgagtccataacagaggagaatggacatggtggcctctaacctggcggcagcgcaaaagatg

SEQ ID NO: 240644 - DNA, 103 bp, Artificial Sequence
  Synthetic Polynucleotide
taatacgactcactatagggcaggtttctaaaggtttcccgcatcacatcaacagaggagagatgtgatgcgggaaaccaacctggcggcagcgcaaaagatg

SEQ ID NO: 240645 - DNA, 103 bp, Artificial Sequence
  Synthetic Polynucleotide
taatacgactcactatagggattacattcatagggtttctccccagtatgaacagaggagacatactatggagaaacccaacctggcggcagcgcaaaagatg

SEQ ID NO: 240646 - DNA, 103 bp, Artificial Sequence
  Synthetic Polynucleotide
taatacgactcactatagggtaccacatttattacattcatagggtttctaacagaggagaagaaacatgatgaatgtaaacctggcggcagcgcaaaagatg

SEQ ID NO: 240647 - DNA, 103 bp, Artificial Sequence
  Synthetic Polynucleotide
taatacgactcactatagggctgaaggttttaccacatttattacattcaaacagaggagatgaatgatgtaaatgtggaacctggcggcagcgcaaaagatg

SEQ ID NO: 240648 - DNA, 103 bp, Artificial Sequence
  Synthetic Polynucleotide
taatacgactcactatagggactggaagaactgaaggttttaccacatttaacagaggagaaaatgtatgaaaaccttcaacctggcggcagcgcaaaagatg

SEQ ID NO: 240649 - DNA, 103 bp, Artificial Sequence
  Synthetic Polynucleotide
taatacgactcactatagggttcgaacattactggaagaactgaaggtttaacagaggagaaaacctatggttcttccaaacctggcggcagcgcaaaagatg

SEQ ID NO: 240650 - DNA, 103 bp, Artificial Sequence
  Synthetic Polynucleotide
taatacgactcactatagggctttcatgtgttcgaacattactggaagaaaacagaggagattcttcatgtaatgttcgaacctggcggcagcgcaaaagatg

SEQ ID NO: 240651 - DNA, 103 bp, Artificial Sequence
  Synthetic Polynucleotide
taatacgactcactatagggagtgtgagtcctttcatgtgttcgaacattaacagaggagaaatgttatgacacatgaaaacctggcggcagcgcaaaagatg

SEQ ID NO: 240652 - DNA, 103 bp, Artificial Sequence
  Synthetic Polynucleotide
taatacgactcactataggggcttctctccagtgtgagtcctttcatgtgaacagaggagacacatgatgggactcacaaacctggcggcagcgcaaaagatg

SEQ ID NO: 240653 - DNA, 103 bp, Artificial Sequence
  Synthetic Polynucleotide
taatacgactcactatagggcattcatagggcttctctccagtgtgagtcaacagaggagagactcaatgtggagagaaaacctggcggcagcgcaaaagatg

SEQ ID NO: 240654 - DNA, 103 bp, Artificial Sequence
  Synthetic Polynucleotide
taatacgactcactataggggcattccttacattcatagggcttctctccaacagaggagaggagagatgccctatgaaaacctggcggcagcgcaaaagatg

SEQ ID NO: 240655 - DNA, 103 bp, Artificial Sequence
  Synthetic Polynucleotide
taatacgactcactatagggctacacaggccaggtttctaaaggtttcccaacagaggagagggaaaatgttagaaaccaacctggcggcagcgcaaaagatg

SEQ ID NO: 240656 - DNA, 103 bp, Artificial Sequence
  Synthetic Polynucleotide
taatacgactcactatagggaggctttcccgcattccttacattcataggaacagaggagacctatgatggtaaggaataacctggcggcagcgcaaaagatg

SEQ ID NO: 240657 - DNA, 103 bp, Artificial Sequence
  Synthetic Polynucleotide
taatacgactcactatagggagagaaatgaaggctttcccgcattccttaaacagaggagataaggaatgcgggaaagcaacctggcggcagcgcaaaagatg

SEQ ID NO: 240658 - DNA, 103 bp, Artificial Sequence
  Synthetic Polynucleotide
taatacgactcactataggggacacttgggagagaaatgaaggctttcccaacagaggagagggaaaatgttcatttctaacctggcggcagcgcaaaagatg

SEQ ID NO: 240659 - DNA, 103 bp, Artificial Sequence
  Synthetic Polynucleotide
taatacgactcactatagggtgtgtcttcggacacttgggagagaaatgaaacagaggagatcatttatgtcccaagtgaacctggcggcagcgcaaaagatg

SEQ ID NO: 240660 - DNA, 103 bp, Artificial Sequence
  Synthetic Polynucleotide
taatacgactcactatagggtgctttatcatgtgtcttcggacacttgggaacagaggagacccaagatgccgaagacaaacctggcggcagcgcaaaagatg

SEQ ID NO: 240661 - DNA, 103 bp, Artificial Sequence
  Synthetic Polynucleotide
taatacgactcactatagggatctccagtgtgctttatcatgtgtcttcgaacagaggagacgaagaatgatgataaagaacctggcggcagcgcaaaagatg

SEQ ID NO: 240662 - DNA, 103 bp, Artificial Sequence
  Synthetic Polynucleotide
taatacgactcactatagggtataaggtccatctccagtgtgctttatcaaacagaggagatgataaatgacactggagaacctggcggcagcgcaaaagatg

SEQ ID NO: 240663 - DNA, 103 bp, Artificial Sequence
  Synthetic Polynucleotide
taatacgactcactatagggacctgacatttataaggtccatctccagtgaacagaggagacactggatgtggaccttaaacctggcggcagcgcaaaagatg

SEQ ID NO: 240664 - DNA, 103 bp, Artificial Sequence
  Synthetic Polynucleotide
taatacgactcactatagggtctaccacatacctgacatttataaggtccaacagaggagaggacctatgaaatgtcagaacctggcggcagcgcaaaagatg

SEQ ID NO: 240665 - DNA, 103 bp, Artificial Sequence
  Synthetic Polynucleotide
taatacgactcactatagggagtcaaaggctctaccacatacctgacattaacagaggagaaatgtcatgtatgtggtaaacctggcggcagcgcaaaagatg

SEQ ID NO: 240666 - DNA, 103 bp, Artificial Sequence
  Synthetic Polynucleotide
taatacgactcactatagggcatttttttcctacacaggccaggtttctaaacagaggagatagaaaatgggcctgtgtaacctggcggcagcgcaaaagatg

SEQ ID NO: 240667 - DNA, 103 bp, Artificial Sequence
  Synthetic Polynucleotide
taatacgactcactataggggaactgggacagtcaaaggctctaccacataacagaggagaatgtggatgagcctttgaaacctggcggcagcgcaaaagatg

SEQ ID NO: 240668 - DNA, 103 bp, Artificial Sequence
  Synthetic Polynucleotide
taatacgactcactatagggtatttgaaatgaactgggacagtcaaaggcaacagaggagagcctttatgtgtcccagtaacctggcggcagcgcaaaagatg

SEQ ID NO: 240669 - DNA, 103 bp, Artificial Sequence
  Synthetic Polynucleotide
taatacgactcactatagggttctttcgtgtatttgaaatgaactgggacaacagaggagagtcccaatgcatttcaaaaacctggcggcagcgcaaaagatg

SEQ ID NO: 240670 - DNA, 103 bp, Artificial Sequence
  Synthetic Polynucleotide
taatacgactcactatagggccagtgtgagttctttcgtgtatttgaaataacagaggagaatttcaatgacacgaaagaacctggcggcagcgcaaaagatg

SEQ ID NO: 240671 - DNA, 103 bp, Artificial Sequence
  Synthetic Polynucleotide
taatacgactcactataggggggtttctctccagtgtgagttctttcgtgaacagaggagacacgaaatgactcacactaacctggcggcagcgcaaaagatg

SEQ ID NO: 240672 - DNA, 103 bp, Artificial Sequence
  Synthetic Polynucleotide
taatacgactcactataggggacattcatagggtttctctccagtgtgagaacagaggagactcacaatggagagaaacaacctggcggcagcgcaaaagatg

SEQ ID NO: 240673 - DNA, 103 bp, Artificial Sequence
  Synthetic Polynucleotide
taatacgactcactatagggccacatacctgacattcatagggtttctctaacagaggagaagagaaatgctatgaatgaacctggcggcagcgcaaaagatg

SEQ ID NO: 240674 - DNA, 103 bp, Artificial Sequence
  Synthetic Polynucleotide
taatacgactcactataggggaaggctttcccacatacctgacattcataaacagaggagatatgaaatgcaggtatgtaacctggcggcagcgcaaaagatg

SEQ ID NO: 240675 - DNA, 103 bp, Artificial Sequence
  Synthetic Polynucleotide
taatacgactcactatagggtaagagaaatgaaggctttcccacatacctaacagaggagaaggtatatgggaaagcctaacctggcggcagcgcaaaagatg

SEQ ID NO: 240676 - DNA, 103 bp, Artificial Sequence
  Synthetic Polynucleotide
taatacgactcactatagggctaatccttttaagagaaatgaaggctttcaacagaggagagaaagcatgcatttctctaacctggcggcagcgcaaaagatg

SEQ ID NO: 240677 - DNA, 103 bp, Artificial Sequence
  Synthetic Polynucleotide
taatacgactcactatagggctggtcttcccatttttttcctacacaggcaacagaggagagcctgtatgggaaaaaaaaacctggcggcagcgcaaaagatg

SEQ ID NO: 240678 - DNA, 103 bp, Artificial Sequence
  Synthetic Polynucleotide
taatacgactcactatagggcatatgttttctaatccttttaagagaaataacagaggagaatttctatgaaaaggattaacctggcggcagcgcaaaagatg

SEQ ID NO: 240679 - DNA, 103 bp, Artificial Sequence
  Synthetic Polynucleotide
taatacgactcactatagggtgtgcagtatcatatgttttctaatcctttaacagaggagaaaaggaatggaaaacataaacctggcggcagcgcaaaagatg

SEQ ID NO: 240680 - DNA, 103 bp, Artificial Sequence
  Synthetic Polynucleotide
taatacgactcactatagggccatctccagtgtgcagtatcatatgttttaacagaggagaaaaacaatggatactgcaaacctggcggcagcgcaaaagatg

SEQ ID NO: 240681 - DNA, 103 bp, Artificial Sequence
  Synthetic Polynucleotide
taatacgactcactatagggtttataaggtccatctccagtgtgcagtataacagaggagaatactgatgactggagataacctggcggcagcgcaaaagatg

SEQ ID NO: 240682 - DNA, 103 bp, Artificial Sequence
  Synthetic Polynucleotide
taatacgactcactatagggatacctgacatttataaggtccatctccagaacagaggagactggagatggaccttataaacctggcggcagcgcaaaagatg

SEQ ID NO: 240683 - DNA, 103 bp, Artificial Sequence
  Synthetic Polynucleotide
taatacgactcactataggggctttaccacatacctgacatttataaggtaacagaggagaaccttaatgatgtcaggtaacctggcggcagcgcaaaagatg

SEQ ID NO: 240684 - DNA, 103 bp, Artificial Sequence
  Synthetic Polynucleotide
taatacgactcactatagggacagtcaaaggctttaccacatacctgacaaacagaggagatgtcagatgtgtggtaaaaacctggcggcagcgcaaaagatg

SEQ ID NO: 240685 - DNA, 103 bp, Artificial Sequence
  Synthetic Polynucleotide
taatacgactcactatagggcagaactaggacagtcaaaggctttaccacaacagaggagagtggtaatgcctttgactaacctggcggcagcgcaaaagatg

SEQ ID NO: 240686 - DNA, 103 bp, Artificial Sequence
  Synthetic Polynucleotide
taatacgactcactatagggtgtgttcggacagaactaggacagtcaaagaacagaggagactttgaatgtcctagttcaacctggcggcagcgcaaaagatg

SEQ ID NO: 240687 - DNA, 103 bp, Artificial Sequence
  Synthetic Polynucleotide
taatacgactcactatagggagttctttcatgtgttcggacagaactaggaacagaggagacctagtatggtccgaacaaacctggcggcagcgcaaaagatg

SEQ ID NO: 240688 - DNA, 103 bp, Artificial Sequence
  Synthetic Polynucleotide
taatacgactcactatagggcttcaatgctctggtcttcccatttttttcaacagaggagagaaaaaatggggaagaccaacctggcggcagcgcaaaagatg

SEQ ID NO: 240689 - DNA, 103 bp, Artificial Sequence
  Synthetic Polynucleotide
taatacgactcactatagggctccagtatgagttctttcatgtgttcggaaacagaggagatccgaaatgatgaaagaaaacctggcggcagcgcaaaagatg

SEQ ID NO: 240690 - DNA, 103 bp, Artificial Sequence
  Synthetic Polynucleotide
taatacgactcactatagggtagggtttttctccagtatgagttctttcaaacagaggagatgaaagatgtcatactggaacctggcggcagcgcaaaagatg

SEQ ID NO: 240691 - DNA, 103 bp, Artificial Sequence
  Synthetic Polynucleotide
taatacgactcactatagggtttacattcatagggtttttctccagtatgaacagaggagacatactatggaaaaacccaacctggcggcagcgcaaaagatg

SEQ ID NO: 240692 - DNA, 103 bp, Artificial Sequence
  Synthetic Polynucleotide
taatacgactcactatagggtcccacattctttacattcatagggtttttaacagaggagaaaaaacatgatgaatgtaaacctggcggcagcgcaaaagatg

SEQ ID NO: 240693 - DNA, 103 bp, Artificial Sequence
  Synthetic Polynucleotide
taatacgactcactatagggttgaatgctttcccacattctttacattcaaacagaggagatgaatgatgagaatgtggaacctggcggcagcgcaaaagatg

SEQ ID NO: 240694 - DNA, 103 bp, Artificial Sequence
  Synthetic Polynucleotide
taatacgactcactatagggactggcataattgaatgctttcccacattcaacagaggagagaatgtatgaaagcattcaacctggcggcagcgcaaaagatg

SEQ ID NO: 240695 - DNA, 103 bp, Artificial Sequence
  Synthetic Polynucleotide
taatacgactcactatagggttctaatggaactggcataattgaatgcttaacagaggagaaagcatatgattatgccaaacctggcggcagcgcaaaagatg

SEQ ID NO: 240696 - DNA, 103 bp, Artificial Sequence
  Synthetic Polynucleotide
taatacgactcactatagggctttcatgtattctaatggaactggcataaaacagaggagattatgcatgttccattagaacctggcggcagcgcaaaagatg

SEQ ID NO: 240697 - DNA, 103 bp, Artificial Sequence
  Synthetic Polynucleotide
taatacgactcactatagggggtatgagttctttcatgtattctaatggaaacagaggagatccattatgatacatgaaaacctggcggcagcgcaaaagatg

SEQ ID NO: 240698 - DNA, 103 bp, Artificial Sequence
  Synthetic Polynucleotide
taatacgactcactataggggtttttctccggtatgagttctttcatgtaaacagaggagatacatgatggaactcataaacctggcggcagcgcaaaagatg

SEQ ID NO: 240699 - DNA, 103 bp, Artificial Sequence
  Synthetic Polynucleotide
taatacgactcactatagggttgtaccaatcttcaatgctctggtcttccaacagaggagaggaagaatggagcattgaaacctggcggcagcgcaaaagatg

SEQ ID NO: 240700 - DNA, 103 bp, Artificial Sequence
  Synthetic Polynucleotide
taatacgactcactatagggcattcatagggtttttctccggtatgagttaacagaggagaaactcaatgcggagaaaaaacctggcggcagcgcaaaagatg

SEQ ID NO: 240701 - DNA, 103 bp, Artificial Sequence
  Synthetic Polynucleotide
taatacgactcactatagggacattgcttacattcatagggtttttctccaacagaggagaggagaaatgccctatgaaaacctggcggcagcgcaaaagatg

SEQ ID NO: 240702 - DNA, 103 bp, Artificial Sequence
  Synthetic Polynucleotide
taatacgactcactatagggacgtttttccacattgcttacattcataggaacagaggagacctatgatggtaagcaataacctggcggcagcgcaaaagatg

SEQ ID NO: 240703 - DNA, 103 bp, Artificial Sequence
  Synthetic Polynucleotide
taatacgactcactataggggaataactgaacgtttttccacattgcttaaacagaggagataagcaatgtggaaaaacaacctggcggcagcgcaaaagatg

SEQ ID NO: 240704 - DNA, 103 bp, Artificial Sequence
  Synthetic Polynucleotide
taatacgactcactatagggaaaggaactggaataactgaacgtttttccaacagaggagaggaaaaatgttcagttataacctggcggcagcgcaaaagatg

SEQ ID NO: 240705 - DNA, 103 bp, Artificial Sequence
  Synthetic Polynucleotide
taatacgactcactatagggcatgtctttgaaaggaactggaataactgaaacagaggagatcagttatgccagttcctaacctggcggcagcgcaaaagatg

SEQ ID NO: 240706 - DNA, 103 bp, Artificial Sequence
  Synthetic Polynucleotide
taatacgactcactatagggtgagctctttcatgtctttgaaaggaactgaacagaggagacagttcatgtcaaagacaaacctggcggcagcgcaaaagatg

SEQ ID NO: 240707 - DNA, 103 bp, Artificial Sequence
  Synthetic Polynucleotide
taatacgactcactatagggatctccattatgagctctttcatgtctttgaacagaggagacaaagaatggaaagagctaacctggcggcagcgcaaaagatg

SEQ ID NO: 240708 - DNA, 103 bp, Artificial Sequence
  Synthetic Polynucleotide
taatacgactcactatagggcgtaaggtttatctccattatgagctctttaacagaggagaaaagagatgataatggagaacctggcggcagcgcaaaagatg

SEQ ID NO: 240709 - DNA, 103 bp, Artificial Sequence
  Synthetic Polynucleotide
taatacgactcactatagggacattctttacgtaaggtttatctccattaaacagaggagataatggatgtaaaccttaaacctggcggcagcgcaaaagatg

SEQ ID NO: 240710 - DNA, 103 bp, Artificial Sequence
  Synthetic Polynucleotide
taatacgactcactatagggcccctgatttttgtaccaatcttcaatgctaacagaggagaagcattatggattggtacaacctggcggcagcgcaaaagatg

SEQ ID NO: 240711 - DNA, 103 bp, Artificial Sequence
  Synthetic Polynucleotide
taatacgactcactatagggaagctttcccacattctttacgtaaggtttaacagaggagaaaacctatggtaaagaataacctggcggcagcgcaaaagatg

SEQ ID NO: 240712 - DNA, 103 bp, Artificial Sequence
  Synthetic Polynucleotide
taatacgactcactatagggtgataaatgaaagctttcccacattctttaaacagaggagataaagaatgtgggaaagcaacctggcggcagcgcaaaagatg

SEQ ID NO: 240713 - DNA, 103 bp, Artificial Sequence
  Synthetic Polynucleotide
taatacgactcactataggggaaggttgtgtgataaatgaaagctttcccaacagaggagagggaaaatgttcatttataacctggcggcagcgcaaaagatg

SEQ ID NO: 240714 - DNA, 103 bp, Artificial Sequence
  Synthetic Polynucleotide
taatacgactcactatagggacaggtattcgaaggttgtgtgataaatgaaacagaggagatcatttatgacacaacctaacctggcggcagcgcaaaagatg

SEQ ID NO: 240715 - DNA, 103 bp, Artificial Sequence
  Synthetic Polynucleotide
taatacgactcactatagggattcattttcacaggtattcgaaggttgtgaacagaggagacacaacatgcgaatacctaacctggcggcagcgcaaaagatg

SEQ ID NO: 240716 - DNA, 103 bp, Artificial Sequence
  Synthetic Polynucleotide
taatacgactcactatagggttaaaattctcccctgatttttgtaccaataacagaggagaattggtatgaaaatcaggaacctggcggcagcgcaaaagatg

SEQ ID NO: 240717 - DNA, 103 bp, Artificial Sequence
  Synthetic Polynucleotide
taatacgactcactatagggatatgatttcttaaaattctcccctgatttaacagaggagaaaatcaatggagaattttaacctggcggcagcgcaaaagatg

SEQ ID NO: 240718 - DNA, 103 bp, Artificial Sequence
  Synthetic Polynucleotide
taatacgactcactatagggtccctcttccatatgatttcttaaaattctaacagaggagaagaattatgagaaatcataacctggcggcagcgcaaaagatg

SEQ ID NO: 240719 - DNA, 103 bp, Artificial Sequence
  Synthetic Polynucleotide
taatacgactcactatagggtgaagttcacagccacatcctcagaggccaaacagaggagatggcctatgaggatgtggaacctggcggcagcgcaaaagatg

SEQ ID NO: 240720 - DNA, 103 bp, Artificial Sequence
  Synthetic Polynucleotide
taatacgactcactatagggtttcactgagtccctcttccatatgatttcaacagaggagagaaatcatgtggaagaggaacctggcggcagcgcaaaagatg

SEQ ID NO: 240721 - DNA, 103 bp, Artificial Sequence
  Synthetic Polynucleotide
taatacgactcactatagggtattctttactttcactgagtccctcttccaacagaggagaggaagaatgactcagtgaaacctggcggcagcgcaaaagatg

SEQ ID NO: 240722 - DNA, 103 bp, Artificial Sequence
  Synthetic Polynucleotide
taatacgactcactatagggacattgatcatattctttactttcactgagaacagaggagactcagtatgagtaaagaaaacctggcggcagcgcaaaagatg

SEQ ID NO: 240723 - DNA, 103 bp, Artificial Sequence
  Synthetic Polynucleotide
taatacgactcactatagggaggcttctccacattgatcatattctttacaacagaggagagtaaagatgatgatcaataacctggcggcagcgcaaaagatg

SEQ ID NO: 240724 - DNA, 103 bp, Artificial Sequence
  Synthetic Polynucleotide
taatacgactcactatagggatctgactgaaggcttctccacattgatcaaacagaggagatgatcaatgtggagaagcaacctggcggcagcgcaaaagatg

SEQ ID NO: 240725 - DNA, 103 bp, Artificial Sequence
  Synthetic Polynucleotide
taatacgactcactatagggaagattgagaatctgactgaaggcttctccaacagaggagaggagaaatgttcagtcagaacctggcggcagcgcaaaagatg

SEQ ID NO: 240726 - DNA, 103 bp, Artificial Sequence
  Synthetic Polynucleotide
taatacgactcactatagggtgttcagattaagattgagaatctgactgaaacagaggagatcagtcatgttctcaatcaacctggcggcagcgcaaaagatg

SEQ ID NO: 240727 - DNA, 103 bp, Artificial Sequence
  Synthetic Polynucleotide
taatacgactcactatagggggaattttcttgttcagattaagattgagaaacagaggagatctcaaatgtaatctgaaaacctggcggcagcgcaaaagatg

SEQ ID NO: 240728 - DNA, 103 bp, Artificial Sequence
  Synthetic Polynucleotide
taatacgactcactatagggtactatagtaggaattttcttgttcagattaacagaggagaaatctgatgaagaaaattaacctggcggcagcgcaaaagatg

SEQ ID NO: 240729 - DNA, 103 bp, Artificial Sequence
  Synthetic Polynucleotide
taatacgactcactatagggcacatggtcttactatagtaggaattttctaacagaggagaagaaaaatgctactatagaacctggcggcagcgcaaaagatg

SEQ ID NO: 240730 - DNA, 103 bp, Artificial Sequence
  Synthetic Polynucleotide
taatacgactcactatagggtcctcaagtgtgaagttcacagccacatccaacagaggagaggatgtatgtgtgaacttaacctggcggcagcgcaaaagatg

SEQ ID NO: 240731 - DNA, 103 bp, Artificial Sequence
  Synthetic Polynucleotide
taatacgactcactatagggaaactacattcacatggtcttactatagtaaacagaggagatactatatgaagaccatgaacctggcggcagcgcaaaagatg

SEQ ID NO: 240732 - DNA, 103 bp, Artificial Sequence
  Synthetic Polynucleotide
taatacgactcactatagggtttcccacacaaactacattcacatggtctaacagaggagaagaccaatggaatgtagtaacctggcggcagcgcaaaagatg

SEQ ID NO: 240733 - DNA, 103 bp, Artificial Sequence
  Synthetic Polynucleotide
taatacgactcactataggggcatgaagactttcccacacaaactacattaacagaggagaaatgtaatgtgtgtgggaaacctggcggcagcgcaaaagatg

SEQ ID NO: 240734 - DNA, 103 bp, Artificial Sequence
  Synthetic Polynucleotide
taatacgactcactataggggatgaatgatgcatgaagactttcccacacaacagaggagagtgtggatgagtcttcataacctggcggcagcgcaaaagatg

SEQ ID NO: 240735 - DNA, 103 bp, Artificial Sequence
  Synthetic Polynucleotide
taatacgactcactatagggcctactaagggatgaatgatgcatgaagacaacagaggagagtcttcatgcatcattcaaacctggcggcagcgcaaaagatg

SEQ ID NO: 240736 - DNA, 103 bp, Artificial Sequence
  Synthetic Polynucleotide
taatacgactcactatagggatctgatgtgcctactaagggatgaatgataacagaggagaatcattatgcccttagtaaacctggcggcagcgcaaaagatg

SEQ ID NO: 240737 - DNA, 103 bp, Artificial Sequence
  Synthetic Polynucleotide
taatacgactcactatagggccaaggtgagatctgatgtgcctactaaggaacagaggagaccttagatggcacatcagaacctggcggcagcgcaaaagatg

SEQ ID NO: 240738 - DNA, 103 bp, Artificial Sequence
  Synthetic Polynucleotide
taatacgactcactatagggtggtttgtgtccaaggtgagatctgatgtgaacagaggagacacatcatgtctcaccttaacctggcggcagcgcaaaagatg

SEQ ID NO: 240739 - DNA, 103 bp, Artificial Sequence
  Synthetic Polynucleotide
taatacgactcactataggggatagtcatatggtttgtgtccaaggtgagaacagaggagactcaccatggacacaaacaacctggcggcagcgcaaaagatg

SEQ ID NO: 240740 - DNA, 103 bp, Artificial Sequence
  Synthetic Polynucleotide
taatacgactcactatagggccatattcctgatagtcatatggtttgtgtaacagaggagaacacaaatgatatgactaaacctggcggcagcgcaaaagatg

SEQ ID NO: 240741 - DNA, 103 bp, Artificial Sequence
  Synthetic Polynucleotide
taatacgactcactatagggcaaagcccactcctcaagtgtgaagttcacaacagaggagagtgaacatgacacttgagaacctggcggcagcgcaaaagatg

SEQ ID NO: 240742 - DNA, 103 bp, Artificial Sequence
  Synthetic Polynucleotide
taatacgactcactatagggtggtttctctccatattcctgatagtcataaacagaggagatatgacatgcaggaatataacctggcggcagcgcaaaagatg

SEQ ID NO: 240743 - DNA, 103 bp, Artificial Sequence
  Synthetic Polynucleotide
taatacgactcactatagggtacatttatatggtttctctccatattcctaacagaggagaaggaatatggagagaaacaacctggcggcagcgcaaaagatg

SEQ ID NO: 240744 - DNA, 103 bp, Artificial Sequence
  Synthetic Polynucleotide
taatacgactcactatagggccacactgcttacatttatatggtttctctaacagaggagaagagaaatgatataaatgaacctggcggcagcgcaaaagatg

SEQ ID NO: 240745 - DNA, 103 bp, Artificial Sequence
  Synthetic Polynucleotide
taatacgactcactataggggaaggctttcccacactgcttacatttataaacagaggagatataaaatgaagcagtgtaacctggcggcagcgcaaaagatg

SEQ ID NO: 240746 - DNA, 103 bp, Artificial Sequence
  Synthetic Polynucleotide
taatacgactcactataggggacaagaactgaaggctttcccacactgctaacagaggagaagcagtatgggaaagcctaacctggcggcagcgcaaaagatg

SEQ ID NO: 240747 - DNA, 103 bp, Artificial Sequence
  Synthetic Polynucleotide
taatacgactcactatagggcgaaaggattgacaagaactgaaggctttcaacagaggagagaaagcatgcagttcttgaacctggcggcagcgcaaaagatg

SEQ ID NO: 240748 - DNA, 103 bp, Artificial Sequence
  Synthetic Polynucleotide
taatacgactcactatagggttcatgtcttcgaaaggattgacaagaactaacagaggagaagttctatgcaatcctttaacctggcggcagcgcaaaagatg

SEQ ID NO: 240749 - DNA, 103 bp, Artificial Sequence
  Synthetic Polynucleotide
taatacgactcactatagggtgtgagttctttcatgtcttcgaaaggattaacagaggagaaatcctatggaagacatgaacctggcggcagcgcaaaagatg

SEQ ID NO: 240750 - DNA, 103 bp, Artificial Sequence
  Synthetic Polynucleotide
taatacgactcactatagggttctcaccagtgtgagttctttcatgtcttaacagaggagaaagacaatgaagaactcaaacctggcggcagcgcaaaagatg

SEQ ID NO: 240751 - DNA, 103 bp, Artificial Sequence
  Synthetic Polynucleotide
taatacgactcactatagggtgcatagggtttctcaccagtgtgagttctaacagaggagaagaactatgactggtgagaacctggcggcagcgcaaaagatg

SEQ ID NO: 240752 - DNA, 103 bp, Artificial Sequence
  Synthetic Polynucleotide
taatacgactcactatagggaaggatccagcaaagcccactcctcaagtgaacagaggagacacttgatgagtgggcttaacctggcggcagcgcaaaagatg

SEQ ID NO: 240753 - DNA, 103 bp, Artificial Sequence
  Synthetic Polynucleotide
taatacgactcactatagggattccggacatgcatagggtttctcaccagaacagaggagactggtgatgaaccctatgaacctggcggcagcgcaaaagatg

SEQ ID NO: 240754 - DNA, 103 bp, Artificial Sequence
  Synthetic Polynucleotide
taatacgactcactataggggctttcccacattccggacatgcatagggtaacagaggagaaccctaatgatgtccggaaacctggcggcagcgcaaaagatg

SEQ ID NO: 240755 - DNA, 103 bp, Artificial Sequence
  Synthetic Polynucleotide
taatacgactcactatagggagaaatgaaggctttcccacattccggacaaacagaggagatgtccgatgtgtgggaaaaacctggcggcagcgcaaaagatg

SEQ ID NO: 240756 - DNA, 103 bp, Artificial Sequence
  Synthetic Polynucleotide
taatacgactcactatagggcacttgggagagaaatgaaggctttcccacaacagaggagagtgggaatgccttcatttaacctggcggcagcgcaaaagatg

SEQ ID NO: 240757 - DNA, 103 bp, Artificial Sequence
  Synthetic Polynucleotide
taatacgactcactatagggtgtcttcgaacacttgggagagaaatgaagaacagaggagacttcatatgtctcccaagaacctggcggcagcgcaaaagatg

SEQ ID NO: 240758 - DNA, 103 bp, Artificial Sequence
  Synthetic Polynucleotide
taatacgactcactatagggcttaatcatgtgtcttcgaacacttgggagaacagaggagactcccaatggttcgaagaaacctggcggcagcgcaaaagatg

SEQ ID NO: 240759 - DNA, 103 bp, Artificial Sequence
  Synthetic Polynucleotide
taatacgactcactatagggctccagtgtgcttaatcatgtgtcttcgaaaacagaggagattcgaaatgacatgattaaacctggcggcagcgcaaaagatg

SEQ ID NO: 240760 - DNA, 103 bp, Artificial Sequence
  Synthetic Polynucleotide
taatacgactcactatagggtatggtccatctccagtgtgcttaatcatgaacagaggagacatgatatggcacactggaacctggcggcagcgcaaaagatg

SEQ ID NO: 240761 - DNA, 103 bp, Artificial Sequence
  Synthetic Polynucleotide
taatacgactcactatagggctgacatttatatggtccatctccagtgtgaacagaggagacacactatggatggaccaaacctggcggcagcgcaaaagatg

SEQ ID NO: 240762 - DNA, 103 bp, Artificial Sequence
  Synthetic Polynucleotide
taatacgactcactatagggtcccacattcctgacatttatatggtccataacagaggagaatggacatgataaatgtcaacctggcggcagcgcaaaagatg

SEQ ID NO: 240763 - DNA, 103 bp, Artificial Sequence
  Synthetic Polynucleotide
taatacgactcactatagggttcttctgggaaggatccagcaaagcccacaacagaggagagtgggcatggctggatccaacctggcggcagcgcaaaagatg

SEQ ID NO: 240764 - DNA, 103 bp, Artificial Sequence
  Synthetic Polynucleotide
taatacgactcactatagggtcaaaggctttcccacattcctgacatttaaacagaggagataaatgatgggaatgtggaacctggcggcagcgcaaaagatg

SEQ ID NO: 240765 - DNA, 103 bp, Artificial Sequence
  Synthetic Polynucleotide
taatacgactcactatagggacttgggcgatcaaaggctttcccacattcaacagaggagagaatgtatgaaagcctttaacctggcggcagcgcaaaagatg

SEQ ID NO: 240766 - DNA, 103 bp, Artificial Sequence
  Synthetic Polynucleotide
taatacgactcactatagggtctgaaataaacttgggcgatcaaaggcttaacagaggagaaagcctatgatcgcccaaaacctggcggcagcgcaaaagatg

SEQ ID NO: 240767 - DNA, 103 bp, Artificial Sequence
  Synthetic Polynucleotide
taatacgactcactatagggctttcatgtatctgaaataaacttgggcgaaacagaggagatcgcccatgtttatttcaaacctggcggcagcgcaaaagatg

SEQ ID NO: 240768 - DNA, 103 bp, Artificial Sequence
  Synthetic Polynucleotide
taatacgactcactatagggagtgtgagttctttcatgtatctgaaataaaacagaggagattatttatgatacatgaaaacctggcggcagcgcaaaagatg

SEQ ID NO: 240769 - DNA, 103 bp, Artificial Sequence
  Synthetic Polynucleotide
taatacgactcactataggggtttctctccagtgtgagttctttcatgtaaacagaggagatacatgatggaactcacaaacctggcggcagcgcaaaagatg

SEQ ID NO: 240770 - DNA, 103 bp, Artificial Sequence
  Synthetic Polynucleotide
taatacgactcactatagggcattcatagggtttctctccagtgtgagttaacagaggagaaactcaatgtggagagaaaacctggcggcagcgcaaaagatg

SEQ ID NO: 240771 - DNA, 103 bp, Artificial Sequence
  Synthetic Polynucleotide
taatacgactcactatagggacattcctgacattcatagggtttctctccaacagaggagaggagagatgccctatgaaaacctggcggcagcgcaaaagatg

SEQ ID NO: 240772 - DNA, 103 bp, Artificial Sequence
  Synthetic Polynucleotide
taatacgactcactatagggaagcttttgcacattcctgacattcataggaacagaggagacctatgatggtcaggaataacctggcggcagcgcaaaagatg

SEQ ID NO: 240773 - DNA, 103 bp, Artificial Sequence
  Synthetic Polynucleotide
taatacgactcactatagggagagaaatgaaagcttttgcacattcctgaaacagaggagatcaggaatgtgcaaaagcaacctggcggcagcgcaaaagatg

SEQ ID NO: 240774 - DNA, 103 bp, Artificial Sequence
  Synthetic Polynucleotide
taatacgactcactatagggtctgtagagtttcttctgggaaggatccagaacagaggagactggatatgtcccagaagaacctggcggcagcgcaaaagatg

SEQ ID NO: 240775 - DNA, 103 bp, Artificial Sequence
  Synthetic Polynucleotide
taatacgactcactatagggaaaacttggaagagaaatgaaagcttttgcaacagaggagagcaaaaatgttcatttctaacctggcggcagcgcaaaagatg

SEQ ID NO: 240776 - DNA, 103 bp, Artificial Sequence
  Synthetic Polynucleotide
taatacgactcactatagggtgtgtctttgaaaacttggaagagaaatgaaacagaggagatcatttatgttccaagttaacctggcggcagcgcaaaagatg

SEQ ID NO: 240777 - DNA, 103 bp, Artificial Sequence
  Synthetic Polynucleotide
taatacgactcactatagggtgcctaatcatgtgtctttgaaaacttggaaacagaggagatccaagatgtcaaagacaaacctggcggcagcgcaaaagatg

SEQ ID NO: 240778 - DNA, 103 bp, Artificial Sequence
  Synthetic Polynucleotide
taatacgactcactatagggatctccagtgtgcctaatcatgtgtctttgaacagaggagacaaagaatgatgattaggaacctggcggcagcgcaaaagatg

SEQ ID NO: 240779 - DNA, 103 bp, Artificial Sequence
  Synthetic Polynucleotide
taatacgactcactatagggtataaggtccatctccagtgtgcctaatcaaacagaggagatgattaatgacactggagaacctggcggcagcgcaaaagatg

SEQ ID NO: 240780 - DNA, 103 bp, Artificial Sequence
  Synthetic Polynucleotide
taatacgactcactatagggtcctgacatttataaggtccatctccagtgaacagaggagacactggatgtggaccttaaacctggcggcagcgcaaaagatg

SEQ ID NO: 240781 - DNA, 103 bp, Artificial Sequence
  Synthetic Polynucleotide
taatacgactcactatagggttttccacattcctgacatttataaggtccaacagaggagaggacctatgaaatgtcagaacctggcggcagcgcaaaagatg

SEQ ID NO: 240782 - DNA, 103 bp, Artificial Sequence
  Synthetic Polynucleotide
taatacgactcactatagggggtcaaaggcttttccacattcctgacattaacagaggagaaatgtcatgaatgtggaaaacctggcggcagcgcaaaagatg

SEQ ID NO: 240783 - DNA, 103 bp, Artificial Sequence
  Synthetic Polynucleotide
taatacgactcactatagggaaactggggcggtcaaaggcttttccacataacagaggagaatgtggatgagcctttgaaacctggcggcagcgcaaaagatg

SEQ ID NO: 240784 - DNA, 103 bp, Artificial Sequence
  Synthetic Polynucleotide
taatacgactcactatagggtattcgaaataaactggggcggtcaaaggcaacagaggagagcctttatgcgccccagtaacctggcggcagcgcaaaagatg

SEQ ID NO: 240785 - DNA, 103 bp, Artificial Sequence
  Synthetic Polynucleotide
taatacgactcactataggggcatcacatctctgtagagtttcttctgggaacagaggagacccagaatgaactctacaaacctggcggcagcgcaaaagatg

SEQ ID NO: 240786 - DNA, 103 bp, Artificial Sequence
  Synthetic Polynucleotide
taatacgactcactatagggttctttcatgtattcgaaataaactggggcaacagaggagagccccaatgtatttcgaaaacctggcggcagcgcaaaagatg

SEQ ID NO: 240787 - DNA, 103 bp, Artificial Sequence
  Synthetic Polynucleotide
taatacgactcactatagggccagtatgagttctttcatgtattcgaaataacagaggagaatttcgatgacatgaaagaacctggcggcagcgcaaaagatg

SEQ ID NO: 240788 - DNA, 103 bp, Artificial Sequence
  Synthetic Polynucleotide
taatacgactcactataggggggtttctctccagtatgagttctttcatgaacagaggagacatgaaatgactcatactaacctggcggcagcgcaaaagatg

SEQ ID NO: 240789 - DNA, 103 bp, Artificial Sequence
  Synthetic Polynucleotide
taatacgactcactatagggtacattcatggggtttctctccagtatgagaacagaggagactcataatggagagaaacaacctggcggcagcgcaaaagatg

SEQ ID NO: 240790 - DNA, 103 bp, Artificial Sequence
  Synthetic Polynucleotide
taatacgactcactatagggccacactgtttacattcatggggtttctctaacagaggagaagagaaatgccatgaatgaacctggcggcagcgcaaaagatg

SEQ ID NO: 240791 - DNA, 103 bp, Artificial Sequence
  Synthetic Polynucleotide
taatacgactcactataggggaaggccttcccacactgtttacattcatgaacagaggagacatgaaatgaaacagtgtaacctggcggcagcgcaaaagatg

SEQ ID NO: 240792 - DNA, 103 bp, Artificial Sequence
  Synthetic Polynucleotide
taatacgactcactatagggtgaaagaaatgaaggccttcccacactgttaacagaggagaaacagtatgggaaggcctaacctggcggcagcgcaaaagatg

SEQ ID NO: 240793 - DNA, 103 bp, Artificial Sequence
  Synthetic Polynucleotide
taatacgactcactatagggtgaaaatttgtgaaagaaatgaaggccttcaacagaggagagaaggcatgcatttctttaacctggcggcagcgcaaaagatg

SEQ ID NO: 240794 - DNA, 103 bp, Artificial Sequence
  Synthetic Polynucleotide
taatacgactcactatagggcatatgactttgaaaatttgtgaaagaaataacagaggagaatttctatgacaaattttaacctggcggcagcgcaaaagatg

SEQ ID NO: 240795 - DNA, 103 bp, Artificial Sequence
  Synthetic Polynucleotide
taatacgactcactatagggtgtgcctaatcatatgactttgaaaatttgaacagaggagacaaattatgaaagtcataaacctggcggcagcgcaaaagatg

SEQ ID NO: 240796 - DNA, 103 bp, Artificial Sequence
  Synthetic Polynucleotide
taatacgactcactatagggaaggtttcccgcatcacatctctgtagagtaacagaggagaactctaatgagatgtgataacctggcggcagcgcaaaagatg

SEQ ID NO: 240797 - DNA, 103 bp, Artificial Sequence
  Synthetic Polynucleotide
taatacgactcactatagggccatccccagtgtgcctaatcatatgacttaacagaggagaaagtcaatggattaggcaaacctggcggcagcgcaaaagatg

SEQ ID NO: 240798 - DNA, 103 bp, Artificial Sequence
  Synthetic Polynucleotide
taatacgactcactatagggtttataaggtccatccccagtgtgcctaataacagaggagaattaggatgactggggataacctggcggcagcgcaaaagatg

SEQ ID NO: 240799 - DNA, 103 bp, Artificial Sequence
  Synthetic Polynucleotide
taatacgactcactatagggatactttacatttataaggtccatccccagaacagaggagactggggatggaccttataaacctggcggcagcgcaaaagatg

SEQ ID NO: 240800 - DNA, 103 bp, Artificial Sequence
  Synthetic Polynucleotide
taatacgactcactataggggctctcccacatactttacatttataaggtaacagaggagaaccttaatgatgtaaagtaacctggcggcagcgcaaaagatg

SEQ ID NO: 240801 - DNA, 103 bp, Artificial Sequence
  Synthetic Polynucleotide
taatacgactcactatagggaaaaataaaggctctcccacatactttacaaacagaggagatgtaaaatgtgtgggagaaacctggcggcagcgcaaaagatg

SEQ ID NO: 240802 - DNA, 103 bp, Artificial Sequence
  Synthetic Polynucleotide
taatacgactcactatagggcataactgggaaaaataaaggctctcccacaacagaggagagtgggaatgcctttatttaacctggcggcagcgcaaaagatg

SEQ ID NO: 240803 - DNA, 103 bp, Artificial Sequence
  Synthetic Polynucleotide
taatacgactcactatagggtgctttcgaacataactgggaaaaataaagaacagaggagactttatatgtcccagttaaacctggcggcagcgcaaaagatg

SEQ ID NO: 240804 - DNA, 103 bp, Artificial Sequence
  Synthetic Polynucleotide
taatacgactcactatagggagttctttcatgctttcgaacataactgggaacagaggagacccagtatggttcgaaagaacctggcggcagcgcaaaagatg

SEQ ID NO: 240805 - DNA, 103 bp, Artificial Sequence
  Synthetic Polynucleotide
taatacgactcactatagggccccagtatgagttctttcatgctttcgaaaacagaggagattcgaaatgatgaaagaaaacctggcggcagcgcaaaagatg

SEQ ID NO: 240806 - DNA, 103 bp, Artificial Sequence
  Synthetic Polynucleotide
taatacgactcactatagggtagggtttctccccagtatgagttctttcaaacagaggagatgaaagatgtcatactggaacctggcggcagcgcaaaagatg

SEQ ID NO: 240807 - DNA, 103 bp, Artificial Sequence
  Synthetic Polynucleotide
taatacgactcactatagggattgctgatcactgaagattgagatgtcataacagaggagaatgacaatgcaatcttcaaacctggcggcagcgcaaaagatg

SEQ ID NO: 240808 - DNA, 103 bp, Artificial Sequence
  Synthetic Polynucleotide
taatacgactcactatagggatcctcttcttcctcggaaagggcagactcaacagaggagagagtctatgctttccgagaacctggcggcagcgcaaaagatg

SEQ ID NO: 240809 - DNA, 103 bp, Artificial Sequence
  Synthetic Polynucleotide
taatacgactcactatagggcccacattccttacattcatagggtttctcaacagaggagagagaaaatgtatgaatgtaacctggcggcagcgcaaaagatg

SEQ ID NO: 240810 - DNA, 103 bp, Artificial Sequence
  Synthetic Polynucleotide
taatacgactcactatagggtgaaggatttcccacattccttacattcataacagaggagaatgaatatgaggaatgtgaacctggcggcagcgcaaaagatg

SEQ ID NO: 240811 - DNA, 103 bp, Artificial Sequence
  Synthetic Polynucleotide
taatacgactcactatagggtgcttctggctgaaggatttcccacattccaacagaggagaggaatgatggaaatccttaacctggcggcagcgcaaaagatg

SEQ ID NO: 240812 - DNA, 103 bp, Artificial Sequence
  Synthetic Polynucleotide
taatacgactcactatagggaataagattttgcttctggctgaaggatttaacagaggagaaaatccatgagccagaagaacctggcggcagcgcaaaagatg

SEQ ID NO: 240813 - DNA, 103 bp, Artificial Sequence
  Synthetic Polynucleotide
taatacgactcactatagggtctcgtgctcaataagattttgcttctggcaacagaggagagccagaatgaaaatcttaaacctggcggcagcgcaaaagatg

SEQ ID NO: 240814 - DNA, 103 bp, Artificial Sequence
  Synthetic Polynucleotide
taatacgactcactataggggtatgaattttctcgtgctcaataagatttaacagaggagaaaatctatgtgagcacgaaacctggcggcagcgcaaaagatg

SEQ ID NO: 240815 - DNA, 103 bp, Artificial Sequence
  Synthetic Polynucleotide
taatacgactcactatagggtttctccccagtatgaattttctcgtgctcaacagaggagagagcacatgaaaattcataacctggcggcagcgcaaaagatg

SEQ ID NO: 240816 - DNA, 103 bp, Artificial Sequence
  Synthetic Polynucleotide
taatacgactcactatagggatgcataaggtttctccccagtatgaatttaacagaggagaaaattcatgctggggagaaacctggcggcagcgcaaaagatg

SEQ ID NO: 240817 - DNA, 103 bp, Artificial Sequence
  Synthetic Polynucleotide
taatacgactcactatagggcattcattacatgcataaggtttctccccaaacagaggagatggggaatgaccttatgcaacctggcggcagcgcaaaagatg

SEQ ID NO: 240818 - DNA, 103 bp, Artificial Sequence
  Synthetic Polynucleotide
taatacgactcactatagggagctctaccacattcattacatgcataaggaacagaggagaccttatatgtgtaatgaaaacctggcggcagcgcaaaagatg

SEQ ID NO: 240819 - DNA, 103 bp, Artificial Sequence
  Synthetic Polynucleotide
taatacgactcactataggggcctggttgtatcctcttcttcctcggaaaaacagaggagatttccgatgaagaagaggaacctggcggcagcgcaaaagatg

SEQ ID NO: 240820 - DNA, 103 bp, Artificial Sequence
  Synthetic Polynucleotide
taatacgactcactatagggttcgagaaaaagctctaccacattcattacaacagaggagagtaatgatggtggtagagaacctggcggcagcgcaaaagatg

SEQ ID NO: 240821 - DNA, 103 bp, Artificial Sequence
  Synthetic Polynucleotide
taatacgactcactatagggacagatgacattcgagaaaaagctctaccaaacagaggagatggtagatgtttttctcgaacctggcggcagcgcaaaagatg

SEQ ID NO: 240822 - DNA, 103 bp, Artificial Sequence
  Synthetic Polynucleotide
taatacgactcactatagggatgtagcgtaacagatgacattcgagaaaaaacagaggagattttctatgatgtcatctaacctggcggcagcgcaaaagatg

SEQ ID NO: 240823 - DNA, 103 bp, Artificial Sequence
  Synthetic Polynucleotide
taatacgactcactataggggacttctcatatgtagcgtaacagatgacaaacagaggagatgtcatatgttacgctacaacctggcggcagcgcaaaagatg

SEQ ID NO: 240824 - DNA, 103 bp, Artificial Sequence
  Synthetic Polynucleotide
taatacgactcactatagggtcccctgtgtgacttctcatatgtagcgtaaacagaggagatacgctatgtatgagaagaacctggcggcagcgcaaaagatg

SEQ ID NO: 240825 - DNA, 103 bp, Artificial Sequence
  Synthetic Polynucleotide
taatacgactcactatagggatagggtttctcccctgtgtgacttctcataacagaggagaatgagaatgcacacagggaacctggcggcagcgcaaaagatg

SEQ ID NO: 240826 - DNA, 103 bp, Artificial Sequence
  Synthetic Polynucleotide
taatacgactcactatagggtattacatttatagggtttctcccctgtgtaacagaggagaacacagatgagaaaccctaacctggcggcagcgcaaaagatg

SEQ ID NO: 240827 - DNA, 103 bp, Artificial Sequence
  Synthetic Polynucleotide
taatacgactcactatagggtttccacatttattacatttatagggtttcaacagaggagagaaaccatgtaaatgtaaaacctggcggcagcgcaaaagatg

SEQ ID NO: 240828 - DNA, 103 bp, Artificial Sequence
  Synthetic Polynucleotide
taatacgactcactatagggagagaaagcttttccacatttattacatttaacagaggagaaaatgtatgaaatgtggaaacctggcggcagcgcaaaagatg

SEQ ID NO: 240829 - DNA, 103 bp, Artificial Sequence
  Synthetic Polynucleotide
taatacgactcactatagggctgagcattgagagaaagcttttccacattaacagaggagaaatgtgatgaagctttctaacctggcggcagcgcaaaagatg

SEQ ID NO: 240830 - DNA, 103 bp, Artificial Sequence
  Synthetic Polynucleotide
taatacgactcactataggggtttcaagaggcctggttgtatcctcttctaacagaggagaagaagaatgtacaaccagaacctggcggcagcgcaaaagatg

SEQ ID NO: 240831 - DNA, 103 bp, Artificial Sequence
  Synthetic Polynucleotide
taatacgactcactatagggataataaatactgagcattgagagaaagctaacagaggagaagctttatgtcaatgctcaacctggcggcagcgcaaaagatg

SEQ ID NO: 240832 - DNA, 103 bp, Artificial Sequence
  Synthetic Polynucleotide
taatacgactcactatagggtctcatatgtataataaatactgagcattgaacagaggagacaatgcatggtatttattaacctggcggcagcgcaaaagatg

SEQ ID NO: 240833 - DNA, 103 bp, Artificial Sequence
  Synthetic Polynucleotide
taatacgactcactatagggcagtgtgacttctcatatgtataataaataaacagaggagatatttaatgtacatatgaaacctggcggcagcgcaaaagatg

SEQ ID NO: 240834 - DNA, 103 bp, Artificial Sequence
  Synthetic Polynucleotide
taatacgactcactatagggggtttctcaccagtgtgacttctcatatgtaacagaggagaacatatatgaagtcacacaacctggcggcagcgcaaaagatg

SEQ ID NO: 240835 - DNA, 103 bp, Artificial Sequence
  Synthetic Polynucleotide
taatacgactcactatagggacatacatagggtttctcaccagtgtgactaacagaggagaagtcacatgggtgagaaaaacctggcggcagcgcaaaagatg

SEQ ID NO: 240836 - DNA, 103 bp, Artificial Sequence
  Synthetic Polynucleotide
taatacgactcactatagggcacattcactacatacatagggtttctcacaacagaggagagtgagaatgcctatgtataacctggcggcagcgcaaaagatg

SEQ ID NO: 240837 - DNA, 103 bp, Artificial Sequence
  Synthetic Polynucleotide
taatacgactcactatagggaaggctttcccacattcactacatacatagaacagaggagactatgtatgtagtgaatgaacctggcggcagcgcaaaagatg

SEQ ID NO: 240838 - DNA, 103 bp, Artificial Sequence
  Synthetic Polynucleotide
taatacgactcactatagggactctgagagaaggctttcccacattcactaacagaggagaagtgaaatggggaaagccaacctggcggcagcgcaaaagatg

SEQ ID NO: 240839 - DNA, 103 bp, Artificial Sequence
  Synthetic Polynucleotide
taatacgactcactatagggttagggatgaactctgagagaaggctttccaacagaggagaggaaagatgtctctcagaaacctggcggcagcgcaaaagatg

SEQ ID NO: 240840 - DNA, 103 bp, Artificial Sequence
  Synthetic Polynucleotide
taatacgactcactatagggatatgtacggttagggatgaactctgagagaacagaggagactctcaatgttcatccctaacctggcggcagcgcaaaagatg

SEQ ID NO: 240841 - DNA, 103 bp, Artificial Sequence
  Synthetic Polynucleotide
taatacgactcactatagggaaatgtcactgtttcaagaggcctggttgtaacagaggagaacaaccatgcctcttgaaaacctggcggcagcgcaaaagatg

SEQ ID NO: 240842 - DNA, 103 bp, Artificial Sequence
  Synthetic Polynucleotide
taatacgactcactatagggatgatttcgcatatgtacggttagggatgaaacagaggagatcatccatgaccgtacataacctggcggcagcgcaaaagatg

SEQ ID NO: 240843 - DNA, 103 bp, Artificial Sequence
  Synthetic Polynucleotide
taatacgactcactatagggtctcagctgtatgatttcgcatatgtacggaacagaggagaccgtacatgtgcgaaatcaacctggcggcagcgcaaaagatg

SEQ ID NO: 240844 - DNA, 103 bp, Artificial Sequence
  Synthetic Polynucleotide
taatacgactcactatagggtcatagggtttctcagctgtatgatttcgcaacagaggagagcgaaaatgtacagctgaaacctggcggcagcgcaaaagatg

SEQ ID NO: 240845 - DNA, 103 bp, Artificial Sequence
  Synthetic Polynucleotide
taatacgactcactatagggttccttacattcatagggtttctcagctgtaacagaggagaacagctatgaaaccctataacctggcggcagcgcaaaagatg

SEQ ID NO: 240846 - DNA, 103 bp, Artificial Sequence
  Synthetic Polynucleotide
taatacgactcactatagggcttttccacattccttacattcatagggttaacagaggagaaaccctatgaatgtaaggaacctggcggcagcgcaaaagatg

SEQ ID NO: 240847 - DNA, 103 bp, Artificial Sequence
  Synthetic Polynucleotide
taatacgactcactatagggctgctgaaggcttttccacattccttacataacagaggagaatgtaaatgatgtggaaaaacctggcggcagcgcaaaagatg

SEQ ID NO: 240848 - DNA, 103 bp, Artificial Sequence
  Synthetic Polynucleotide
taatacgactcactatagggattttctttcctgctgaaggcttttccacaaacagaggagatgtggaatggccttcagcaacctggcggcagcgcaaaagatg

SEQ ID NO: 240849 - DNA, 103 bp, Artificial Sequence
  Synthetic Polynucleotide
taatacgactcactataggggtgtaatgagattttctttcctgctgaaggaacagaggagaccttcaatgggaaagaaaaacctggcggcagcgcaaaagatg

SEQ ID NO: 240850 - DNA, 103 bp, Artificial Sequence
  Synthetic Polynucleotide
taatacgactcactatagggattttctgatgtgtaatgagattttctttcaacagaggagagaaagaatgtctcattacaacctggcggcagcgcaaaagatg

SEQ ID NO: 240851 - DNA, 103 bp, Artificial Sequence
  Synthetic Polynucleotide
taatacgactcactatagggtccagtgtgaattttctgatgtgtaatgagaacagaggagactcattatgcatcagaaaaacctggcggcagcgcaaaagatg

SEQ ID NO: 240852 - DNA, 103 bp, Artificial Sequence
  Synthetic Polynucleotide
taatacgactcactatagggccacatccttaaatgtcactgtttcaagagaacagaggagactcttgatgcagtgacataacctggcggcagcgcaaaagatg

SEQ ID NO: 240853 - DNA, 103 bp, Artificial Sequence
  Synthetic Polynucleotide
taatacgactcactatagggaaggtttctctccagtgtgaattttctgataacagaggagaatcagaatgttcacactgaacctggcggcagcgcaaaagatg

SEQ ID NO: 240854 - DNA, 103 bp, Artificial Sequence
  Synthetic Polynucleotide
taatacgactcactatagggctgcattcataaggtttctctccagtgtgaaacagaggagatcacacatgagagaaaccaacctggcggcagcgcaaaagatg

SEQ ID NO: 240855 - DNA, 103 bp, Artificial Sequence
  Synthetic Polynucleotide
taatacgactcactatagggcccacattcactgcattcataaggtttctcaacagaggagagagaaaatgtatgaatgcaacctggcggcagcgcaaaagatg

SEQ ID NO: 240856 - DNA, 103 bp, Artificial Sequence
  Synthetic Polynucleotide
taatacgactcactatagggtaaaagctttcccacattcactgcattcataacagaggagaatgaatatggtgaatgtgaacctggcggcagcgcaaaagatg

SEQ ID NO: 240857 - DNA, 103 bp, Artificial Sequence
  Synthetic Polynucleotide
taatacgactcactataggggacatctgaataaaagctttcccacattcaaacagaggagatgaatgatggaaagctttaacctggcggcagcgcaaaagatg

SEQ ID NO: 240858 - DNA, 103 bp, Artificial Sequence
  Synthetic Polynucleotide
taatacgactcactatagggaatgaggtttgacatctgaataaaagctttaacagaggagaaaagctatgattcagatgaacctggcggcagcgcaaaagatg

SEQ ID NO: 240859 - DNA, 103 bp, Artificial Sequence
  Synthetic Polynucleotide
taatacgactcactatagggtctggtgtcgaatgaggtttgacatctgaaaacagaggagattcagaatgcaaacctcaaacctggcggcagcgcaaaagatg

SEQ ID NO: 240860 - DNA, 103 bp, Artificial Sequence
  Synthetic Polynucleotide
taatacgactcactataggggtatgaattctctggtgtcgaatgaggtttaacagaggagaaaacctatgtcgacaccaaacctggcggcagcgcaaaagatg

SEQ ID NO: 240861 - DNA, 103 bp, Artificial Sequence
  Synthetic Polynucleotide
taatacgactcactatagggtttctcacccgtatgaattctctggtgtcgaacagaggagacgacacatgagaattcataacctggcggcagcgcaaaagatg

SEQ ID NO: 240862 - DNA, 103 bp, Artificial Sequence
  Synthetic Polynucleotide
taatacgactcactatagggatgcatagggtttctcacccgtatgaattcaacagaggagagaattcatgcgggtgagaaacctggcggcagcgcaaaagatg

SEQ ID NO: 240863 - DNA, 103 bp, Artificial Sequence
  Synthetic Polynucleotide
taatacgactcactatagggaggtcaacagccacatccttaaatgtcactaacagaggagaagtgacatgtaaggatgtaacctggcggcagcgcaaaagatg

SEQ ID NO: 240864 - DNA, 103 bp, Artificial Sequence
  Synthetic Polynucleotide
taatacgactcactatagggcatactgtacatgcatagggtttctcacccaacagaggagagggtgaatgaccctatgcaacctggcggcagcgcaaaagatg

SEQ ID NO: 240865 - DNA, 103 bp, Artificial Sequence
  Synthetic Polynucleotide
taatacgactcactatagggggcttttccacatactgtacatgcatagggaacagaggagaccctatatgtgtacagtaaacctggcggcagcgcaaaagatg

SEQ ID NO: 240866 - DNA, 103 bp, Artificial Sequence
  Synthetic Polynucleotide
taatacgactcactatagggtctgactaaaggcttttccacatactgtacaacagaggagagtacagatggtggaaaagaacctggcggcagcgcaaaagatg

SEQ ID NO: 240867 - DNA, 103 bp, Artificial Sequence
  Synthetic Polynucleotide
taatacgactcactatagggaggtttgatttctgactaaaggcttttccaaacagaggagatggaaaatgctttagtcaaacctggcggcagcgcaaaagatg

SEQ ID NO: 240868 - DNA, 103 bp, Artificial Sequence
  Synthetic Polynucleotide
taatacgactcactatagggatgttcagtgaggtttgatttctgactaaaaacagaggagatttagtatgaaatcaaacaacctggcggcagcgcaaaagatg

SEQ ID NO: 240869 - DNA, 103 bp, Artificial Sequence
  Synthetic Polynucleotide
taatacgactcactataggggaattttctcatgttcagtgaggtttgattaacagaggagaaatcaaatgtcactgaacaacctggcggcagcgcaaaagatg

SEQ ID NO: 240870 - DNA, 103 bp, Artificial Sequence
  Synthetic Polynucleotide
taatacgactcactatagggtctccagtatgaattttctcatgttcagtgaacagaggagacactgaatgtgagaaaataacctggcggcagcgcaaaagatg

SEQ ID NO: 240871 - DNA, 103 bp, Artificial Sequence
  Synthetic Polynucleotide
taatacgactcactatagggataaggtttctctccagtatgaattttctcaacagaggagagagaaaatgcatactggaaacctggcggcagcgcaaaagatg

SEQ ID NO: 240872 - DNA, 103 bp, Artificial Sequence
  Synthetic Polynucleotide
taatacgactcactataggggattacaatgataaggtttctctccagtataacagaggagaatactgatgagaaaccttaacctggcggcagcgcaaaagatg

SEQ ID NO: 240873 - DNA, 103 bp, Artificial Sequence
  Synthetic Polynucleotide
taatacgactcactatagggttcccacattgattacaatgataaggtttcaacagaggagagaaaccatgtcattgtaaaacctggcggcagcgcaaaagatg

SEQ ID NO: 240874 - DNA, 103 bp, Artificial Sequence
  Synthetic Polynucleotide
taatacgactcactatagggctcctgggtaaggtcaacagccacatccttaacagaggagaaaggatatggctgttgacaacctggcggcagcgcaaaagatg

SEQ ID NO: 240875 - DNA, 103 bp, Artificial Sequence
  Synthetic Polynucleotide
taatacgactcactatagggactgaaagctttcccacattgattacaatgaacagaggagacattgtatgcaatgtgggaacctggcggcagcgcaaaagatg

SEQ ID NO: 240876 - DNA, 103 bp, Artificial Sequence
  Synthetic Polynucleotide
taatacgactcactatagggtttgtctctgactgaaagctttcccacattaacagaggagaaatgtgatgaagctttcaaacctggcggcagcgcaaaagatg

SEQ ID NO: 240877 - DNA, 103 bp, Artificial Sequence
  Synthetic Polynucleotide
taatacgactcactatagggtcaagaagattttgtctctgactgaaagctaacagaggagaagctttatgtcagagacaaacctggcggcagcgcaaaagatg

SEQ ID NO: 240878 - DNA, 103 bp, Artificial Sequence
  Synthetic Polynucleotide
taatacgactcactatagggtttttcatgctcaagaagattttgtctctgaacagaggagacagagaatgaatcttcttaacctggcggcagcgcaaaagatg

SEQ ID NO: 240879 - DNA, 103 bp, Artificial Sequence
  Synthetic Polynucleotide
taatacgactcactatagggcagtatgaattttttcatgctcaagaagataacagaggagaatcttcatgagcatgaaaaacctggcggcagcgcaaaagatg

SEQ ID NO: 240880 - DNA, 103 bp, Artificial Sequence
  Synthetic Polynucleotide
taatacgactcactatagggggtttctctccagtatgaattttttcatgcaacagaggagagcatgaatgaattcatacaacctggcggcagcgcaaaagatg

SEQ ID NO: 240881 - DNA, 103 bp, Artificial Sequence
  Synthetic Polynucleotide
taatacgactcactatagggacatttgaatggtttctctccagtatgaataacagaggagaattcatatgggagagaaaaacctggcggcagcgcaaaagatg

SEQ ID NO: 240882 - DNA, 103 bp, Artificial Sequence
  Synthetic Polynucleotide
taatacgactcactatagggcacattcattacatttgaatggtttctctcaacagaggagagagagaatgcattcaaataacctggcggcagcgcaaaagatg

SEQ ID NO: 240883 - DNA, 103 bp, Artificial Sequence
  Synthetic Polynucleotide
taatacgactcactatagggaaggctttaccacattcattacatttgaataacagaggagaattcaaatgtaatgaatgaacctggcggcagcgcaaaagatg

SEQ ID NO: 240884 - DNA, 103 bp, Artificial Sequence
  Synthetic Polynucleotide
taatacgactcactataggggattcgagagaaggctttaccacattcattaacagaggagaaatgaaatgggtaaagccaacctggcggcagcgcaaaagatg

SEQ ID NO: 240885 - DNA, 103 bp, Artificial Sequence
  Synthetic Polynucleotide
taatacgactcactataggggctcccactcctcctgggtaaggtcaacagaacagaggagactgttgatgttacccaggaacctggcggcagcgcaaaagatg

SEQ ID NO: 240886 - DNA, 103 bp, Artificial Sequence
  Synthetic Polynucleotide
taatacgactcactatagggtgagggatgagattcgagagaaggctttacaacagaggagagtaaagatgtctctcgaaaacctggcggcagcgcaaaagatg

SEQ ID NO: 240887 - DNA, 103 bp, Artificial Sequence
  Synthetic Polynucleotide
taatacgactcactatagggacatgaagagtgagggatgagattcgagagaacagaggagactctcgatgctcatccctaacctggcggcagcgcaaaagatg

SEQ ID NO: 240888 - DNA, 103 bp, Artificial Sequence
  Synthetic Polynucleotide
taatacgactcactataggggtgacttctcacatgaagagtgagggatgaaacagaggagatcatccatgactcttcataacctggcggcagcgcaaaagatg

SEQ ID NO: 240889 - DNA, 103 bp, Artificial Sequence
  Synthetic Polynucleotide
taatacgactcactatagggtctcccctgtgtgacttctcacatgaagagaacagaggagactcttcatgtgagaagtcaacctggcggcagcgcaaaagatg

SEQ ID NO: 240890 - DNA, 103 bp, Artificial Sequence
  Synthetic Polynucleotide
taatacgactcactatagggtcatagggtttctcccctgtgtgacttctcaacagaggagagagaagatgcacaggggaaacctggcggcagcgcaaaagatg

SEQ ID NO: 240891 - DNA, 103 bp, Artificial Sequence
  Synthetic Polynucleotide
taatacgactcactatagggtttattacattcatagggtttctcccctgtaacagaggagaacagggatgaaaccctataacctggcggcagcgcaaaagatg

SEQ ID NO: 240892 - DNA, 103 bp, Artificial Sequence
  Synthetic Polynucleotide
taatacgactcactatagggctttcccacatttattacattcatagggttaacagaggagaaaccctatgaatgtaataaacctggcggcagcgcaaaagatg

SEQ ID NO: 240893 - DNA, 103 bp, Artificial Sequence
  Synthetic Polynucleotide
taatacgactcactatagggtgagaaaaggctttcccacatttattacataacagaggagaatgtaaatgatgtgggaaaacctggcggcagcgcaaaagatg

SEQ ID NO: 240894 - DNA, 103 bp, Artificial Sequence
  Synthetic Polynucleotide
taatacgactcactatagggtaatgagcactgagaaaaggctttcccacaaacagaggagatgtgggatggccttttctaacctggcggcagcgcaaaagatg

SEQ ID NO: 240895 - DNA, 103 bp, Artificial Sequence
  Synthetic Polynucleotide
taatacgactcactataggggtataataagtaatgagcactgagaaaaggaacagaggagaccttttatgagtgctcataacctggcggcagcgcaaaagatg

SEQ ID NO: 240896 - DNA, 103 bp, Artificial Sequence
  Synthetic Polynucleotide
taatacgactcactatagggggtttcatttgctcccactcctcctgggtaaacagaggagatacccaatgggagtgggaaacctggcggcagcgcaaaagatg

SEQ ID NO: 240897 - DNA, 103 bp, Artificial Sequence
  Synthetic Polynucleotide
taatacgactcactatagggcttctcatatgtataataagtaatgagcacaacagaggagagtgctcatgacttattataacctggcggcagcgcaaaagatg

SEQ ID NO: 240898 - DNA, 103 bp, Artificial Sequence
  Synthetic Polynucleotide
taatacgactcactatagggaccagtatgacttctcatatgtataataagaacagaggagacttattatgcatatgagaaacctggcggcagcgcaaaagatg

SEQ ID NO: 240899 - DNA, 103 bp, Artificial Sequence
  Synthetic Polynucleotide
taatacgactcactatagggagggtttctcaccagtatgacttctcatataacagaggagaatatgaatggtcatactgaacctggcggcagcgcaaaagatg

SEQ ID NO: 240900 - DNA, 103 bp, Artificial Sequence
  Synthetic Polynucleotide
taatacgactcactatagggttacattcaaagggtttctcaccagtatgaaacagaggagatcatacatgtgagaaaccaacctggcggcagcgcaaaagatg

SEQ ID NO: 240901 - DNA, 103 bp, Artificial Sequence
  Synthetic Polynucleotide
taatacgactcactatagggcccacattcattacattcaaagggtttctcaacagaggagagagaaaatgtttgaatgtaacctggcggcagcgcaaaagatg

SEQ ID NO: 240902 - DNA, 103 bp, Artificial Sequence
  Synthetic Polynucleotide
taatacgactcactatagggagaatgctttcccacattcattacattcaaaacagaggagattgaatatgatgaatgtgaacctggcggcagcgcaaaagatg

SEQ ID NO: 240903 - DNA, 103 bp, Artificial Sequence
  Synthetic Polynucleotide
taatacgactcactataggggctctttgagagaatgctttcccacattcaaacagaggagatgaatgatggaaagcattaacctggcggcagcgcaaaagatg

SEQ ID NO: 240904 - DNA, 103 bp, Artificial Sequence
  Synthetic Polynucleotide
taatacgactcactatagggagaaagggatgctctttgagagaatgctttaacagaggagaaaagcaatgtctcaaagaaacctggcggcagcgcaaaagatg

SEQ ID NO: 240905 - DNA, 103 bp, Artificial Sequence
  Synthetic Polynucleotide
taatacgactcactatagggtcttatgtatagaaagggatgctctttgagaacagaggagactcaaaatgcatccctttaacctggcggcagcgcaaaagatg

SEQ ID NO: 240906 - DNA, 103 bp, Artificial Sequence
  Synthetic Polynucleotide
taatacgactcactataggggtatgacctctcttatgtatagaaagggataacagaggagaatccctatgtatacataaaacctggcggcagcgcaaaagatg

SEQ ID NO: 240907 - DNA, 103 bp, Artificial Sequence
  Synthetic Polynucleotide
taatacgactcactatagggtctttgagcaggtttcatttgctcccactcaacagaggagagagtggatgcaaatgaaaaacctggcggcagcgcaaaagatg

SEQ ID NO: 240908 - DNA, 103 bp, Artificial Sequence
  Synthetic Polynucleotide
taatacgactcactatagggtctctcacctgtatgacctctcttatgtataacagaggagaatacatatgagaggtcataacctggcggcagcgcaaaagatg

SEQ ID NO: 240909 - DNA, 103 bp, Artificial Sequence
  Synthetic Polynucleotide
taatacgactcactatagggatacttggtgtctctcacctgtatgacctcaacagaggagagaggtcatgcaggtgagaaacctggcggcagcgcaaaagatg

SEQ ID NO: 240910 - DNA, 103 bp, Artificial Sequence
  Synthetic Polynucleotide
taatacgactcactatagggtcacacagctattgctgatcactgaagattaacagaggagaaatcttatgtgatcagcaaacctggcggcagcgcaaaagatg

SEQ ID NO: 240911 - DNA, 103 bp, Artificial Sequence
  Synthetic Polynucleotide
taatacgactcactataggggatacaagtttctttgagcaggtttcatttaacagaggagaaaatgaatgctgctcaaaaacctggcggcagcgcaaaagatg

SEQ ID NO: 240912 - DNA, 103 bp, Artificial Sequence
  Synthetic Polynucleotide
taatacgactcactatagggatcacatctcgatacaagtttctttgagcaaacagaggagatgctcaatgaaacttgtaaacctggcggcagcgcaaaagatg

SEQ ID NO: 240913 - DNA, 103 bp, Artificial Sequence
  Synthetic Polynucleotide
taatacgactcactataggggttctccagcatcacatctcgatacaagttaacagaggagaaacttgatgcgagatgtgaacctggcggcagcgcaaaagatg

SEQ ID NO: 240914 - DNA, 103 bp, Artificial Sequence
  Synthetic Polynucleotide
taatacgactcactatagggggttgctgtagttctccagcatcacatctcaacagaggagagagatgatgtgctggagaaacctggcggcagcgcaaaagatg

SEQ ID NO: 240915 - DNA, 103 bp, Artificial Sequence
  Synthetic Polynucleotide
taatacgactcactatagggactgtgactaggttgctgtagttctccagcaacagaggagagctggaatgctacagcaaaacctggcggcagcgcaaaagatg

SEQ ID NO: 240916 - DNA, 103 bp, Artificial Sequence
  Synthetic Polynucleotide
taatacgactcactatagggttgacagcccactgtgactaggttgctgtaaacagaggagatacagcatgctagtcacaaacctggcggcagcgcaaaagatg

SEQ ID NO: 240917 - DNA, 103 bp, Artificial Sequence
  Synthetic Polynucleotide
taatacgactcactataggggtttggtgacttgacagcccactgtgactaaacagaggagatagtcaatgtgggctgtcaacctggcggcagcgcaaaagatg

SEQ ID NO: 240918 - DNA, 103 bp, Artificial Sequence
  Synthetic Polynucleotide
taatacgactcactatagggatcacatccggtttggtgacttgacagcccaacagaggagagggctgatgagtcaccaaaacctggcggcagcgcaaaagatg

SEQ ID NO: 240919 - DNA, 103 bp, Artificial Sequence
  Synthetic Polynucleotide
taatacgactcactatagggcaacttgaatatcacatccggtttggtgacaacagaggagagtcaccatgccggatgtgaacctggcggcagcgcaaaagatg

SEQ ID NO: 240920 - DNA, 103 bp, Artificial Sequence
  Synthetic Polynucleotide
taatacgactcactatagggcttcttgctccaacttgaatatcacatccgaacagaggagacggatgatgtattcaagtaacctggcggcagcgcaaaagatg

SEQ ID NO: 240921 - DNA, 103 bp, Artificial Sequence
  Synthetic Polynucleotide
taatacgactcactatagggcgctccattgtcacacagctattgctgatcaacagaggagagatcagatgtagctgtgtaacctggcggcagcgcaaaagatg

SEQ ID NO: 240922 - DNA, 103 bp, Artificial Sequence
  Synthetic Polynucleotide
taatacgactcactatagggcagggctcctcttcttgctccaacttgaataacagaggagaattcaaatgggagcaagaaacctggcggcagcgcaaaagatg

SEQ ID NO: 240923 - DNA, 103 bp, Artificial Sequence
  Synthetic Polynucleotide
taatacgactcactatagggctccatcacccagggctcctcttcttgctcaacagaggagagagcaaatggaggagcccaacctggcggcagcgcaaaagatg

SEQ ID NO: 240924 - DNA, 103 bp, Artificial Sequence
  Synthetic Polynucleotide
taatacgactcactatagggacatttcttcctccatcacccagggctcctaacagaggagaaggagcatggggtgatggaacctggcggcagcgcaaaagatg

SEQ ID NO: 240925 - DNA, 103 bp, Artificial Sequence
  Synthetic Polynucleotide
taatacgactcactatagggtgcctcccaaacatttcttcctccatcaccaacagaggagaggtgatatgggaagaaataacctggcggcagcgcaaaagatg

SEQ ID NO: 240926 - DNA, 103 bp, Artificial Sequence
  Synthetic Polynucleotide
taatacgactcactatagggttctggacagtgcctcccaaacatttcttcaacagaggagagaagaaatgtttgggaggaacctggcggcagcgcaaaagatg

SEQ ID NO: 240927 - DNA, 103 bp, Artificial Sequence
  Synthetic Polynucleotide
taatacgactcactatagggcttcccaaacttctggacagtgcctcccaaaacagaggagattgggaatgactgtccagaacctggcggcagcgcaaaagatg

SEQ ID NO: 240928 - DNA, 103 bp, Artificial Sequence
  Synthetic Polynucleotide
taatacgactcactatagggtgttcatcaacttcccaaacttctggacagaacagaggagactgtccatgagtttgggaaacctggcggcagcgcaaaagatg

SEQ ID NO: 240929 - DNA, 103 bp, Artificial Sequence
  Synthetic Polynucleotide
taatacgactcactatagggcttcttgatctgttcatcaacttcccaaacaacagaggagagtttggatggttgatgaaaacctggcggcagcgcaaaagatg

SEQ ID NO: 240930 - DNA, 103 bp, Artificial Sequence
  Synthetic Polynucleotide
taatacgactcactatagggtttcctgttgcttcttgatctgttcatcaaaacagaggagattgatgatgagatcaagaaacctggcggcagcgcaaaagatg

SEQ ID NO: 240931 - DNA, 103 bp, Artificial Sequence
  Synthetic Polynucleotide
taatacgactcactatagggctcacaagtgtttcctgttgcttcttgatcaacagaggagagatcaaatggcaacaggaaacctggcggcagcgcaaaagatg

SEQ ID NO: 240932 - DNA, 103 bp, Artificial Sequence
  Synthetic Polynucleotide
taatacgactcactataggggtggctcaaacgctccattgtcacacagctaacagaggagaagctgtatgacaatggagaacctggcggcagcgcaaaagatg

SEQ ID NO: 240933 - DNA, 103 bp, Artificial Sequence
  Synthetic Polynucleotide
taatacgactcactatagggtgtgactttcctcacaagtgtttcctgttgaacagaggagacaacagatgacacttgtgaacctggcggcagcgcaaaagatg

SEQ ID NO: 240934 - DNA, 103 bp, Artificial Sequence
  Synthetic Polynucleotide
taatacgactcactatagggtggagatggatgtgactttcctcacaagtgaacagaggagacacttgatgggaaagtcaaacctggcggcagcgcaaaagatg

SEQ ID NO: 240935 - DNA, 103 bp, Artificial Sequence
  Synthetic Polynucleotide
taatacgactcactatagggagaattttcttggagatggatgtgactttcaacagaggagagaaagtatgatccatctcaacctggcggcagcgcaaaagatg

SEQ ID NO: 240936 - DNA, 103 bp, Artificial Sequence
  Synthetic Polynucleotide
taatacgactcactatagggttcctttatcagaattttcttggagatggaaacagaggagatccatcatgaagaaaattaacctggcggcagcgcaaaagatg

SEQ ID NO: 240937 - DNA, 103 bp, Artificial Sequence
  Synthetic Polynucleotide
taatacgactcactatagggcaatgactttttcctttatcagaattttctaacagaggagaagaaaaatgtgataaaggaacctggcggcagcgcaaaagatg

SEQ ID NO: 240938 - DNA, 103 bp, Artificial Sequence
  Synthetic Polynucleotide
taatacgactcactatagggtttttacattcaatgactttttcctttatcaacagaggagagataaaatgaaaagtcataacctggcggcagcgcaaaagatg

SEQ ID NO: 240939 - DNA, 103 bp, Artificial Sequence
  Synthetic Polynucleotide
taatacgactcactatagggtttcgcaacttttttacattcaatgactttaacagaggagaaaagtcatggaatgtaaaaacctggcggcagcgcaaaagatg

SEQ ID NO: 240940 - DNA, 103 bp, Artificial Sequence
  Synthetic Polynucleotide
taatacgactcactataggggaggaaatattttcgcaacttttttacattaacagaggagaaatgtaatgaagttgcgaaacctggcggcagcgcaaaagatg

SEQ ID NO: 240941 - DNA, 103 bp, Artificial Sequence
  Synthetic Polynucleotide
taatacgactcactatagggtctgaactcagaggaaatattttcgcaactaacagaggagaagttgcatgaatatttccaacctggcggcagcgcaaaagatg

SEQ ID NO: 240942 - DNA, 103 bp, Artificial Sequence
  Synthetic Polynucleotide
taatacgactcactatagggagtaacaatgtctgaactcagaggaaatataacagaggagaatatttatgctgagttcaaacctggcggcagcgcaaaagatg

SEQ ID NO: 240943 - DNA, 103 bp, Artificial Sequence
  Synthetic Polynucleotide
taatacgactcactatagggtttccatcatgtggctcaaacgctccattgaacagaggagacaatggatggtttgagccaacctggcggcagcgcaaaagatg

SEQ ID NO: 240944 - DNA, 103 bp, Artificial Sequence
  Synthetic Polynucleotide
taatacgactcactatagggtttgtcttgaagtaacaatgtctgaactcaaacagaggagatgagttatgacattgttaaacctggcggcagcgcaaaagatg

SEQ ID NO: 240945 - DNA, 103 bp, Artificial Sequence
  Synthetic Polynucleotide
taatacgactcactatagggtcatagaagctttgtcttgaagtaacaatgaacagaggagacattgtatgttcaagacaaacctggcggcagcgcaaaagatg

SEQ ID NO: 240946 - DNA, 103 bp, Artificial Sequence
  Synthetic Polynucleotide
taatacgactcactatagggtgagtcacagtcatagaagctttgtcttgaaacagaggagatcaagaatgagcttctataacctggcggcagcgcaaaagatg

SEQ ID NO: 240947 - DNA, 103 bp, Artificial Sequence
  Synthetic Polynucleotide
taatacgactcactatagggccttatcaagtgagtcacagtcatagaagcaacagaggagagcttctatgactgtgactaacctggcggcagcgcaaaagatg

SEQ ID NO: 240948 - DNA, 103 bp, Artificial Sequence
  Synthetic Polynucleotide
taatacgactcactatagggtgttccaaacccttatcaagtgagtcacagaacagaggagactgtgaatgacttgataaaacctggcggcagcgcaaaagatg

SEQ ID NO: 240949 - DNA, 103 bp, Artificial Sequence
  Synthetic Polynucleotide
taatacgactcactataggggtctaaattatgttccaaacccttatcaagaacagaggagacttgatatgggtttggaaaacctggcggcagcgcaaaagatg

SEQ ID NO: 240950 - DNA, 103 bp, Artificial Sequence
  Synthetic Polynucleotide
taatacgactcactatagggatctaagtaagtctaaattatgttccaaacaacagaggagagtttggatgataatttagaacctggcggcagcgcaaaagatg

SEQ ID NO: 240951 - DNA, 103 bp, Artificial Sequence
  Synthetic Polynucleotide
taatacgactcactatagggcctttctcatatctaagtaagtctaaattaaacagaggagataatttatgcttacttagaacctggcggcagcgcaaaagatg

SEQ ID NO: 240952 - DNA, 103 bp, Artificial Sequence
  Synthetic Polynucleotide
taatacgactcactatagggtcttacacagcctttctcatatctaagtaaaacagaggagattacttatgtatgagaaaaacctggcggcagcgcaaaagatg

SEQ ID NO: 240953 - DNA, 103 bp, Artificial Sequence
  Synthetic Polynucleotide
taatacgactcactatagggtctgtttctctcttacacagcctttctcataacagaggagaatgagaatggctgtgtaaaacctggcggcagcgcaaaagatg

SEQ ID NO: 240954 - DNA, 103 bp, Artificial Sequence
  Synthetic Polynucleotide
taatacgactcactatagggcaagctttcctttccatcatgtggctcaaaaacagaggagatttgagatgcatgatggaaacctggcggcagcgcaaaagatg

SEQ ID NO: 240955 - DNA, 103 bp, Artificial Sequence
  Synthetic Polynucleotide
taatacgactcactatagggaactcattactctgtttctctcttacacagaacagaggagactgtgtatgagagaaacaaacctggcggcagcgcaaaagatg

SEQ ID NO: 240956 - DNA, 103 bp, Artificial Sequence
  Synthetic Polynucleotide
taatacgactcactatagggtggtttcccaaactcattactctgtttctcaacagaggagagagaaaatgagtaatgagaacctggcggcagcgcaaaagatg

SEQ ID NO: 240957 - DNA, 103 bp, Artificial Sequence
  Synthetic Polynucleotide
taatacgactcactatagggaatggtaaaatggtttcccaaactcattacaacagaggagagtaatgatgttgggaaacaacctggcggcagcgcaaaagatg

SEQ ID NO: 240958 - DNA, 103 bp, Artificial Sequence
  Synthetic Polynucleotide
taatacgactcactatagggtaggatgcacaatggtaaaatggtttcccaaacagaggagatgggaaatgattttaccaaacctggcggcagcgcaaaagatg

SEQ ID NO: 240959 - DNA, 103 bp, Artificial Sequence
  Synthetic Polynucleotide
taatacgactcactatagggggttacaacataggatgcacaatggtaaaaaacagaggagattttacatgtgtgcatccaacctggcggcagcgcaaaagatg

SEQ ID NO: 240960 - DNA, 103 bp, Artificial Sequence
  Synthetic Polynucleotide
taatacgactcactatagggacttaaagggggttacaacataggatgcacaacagaggagagtgcatatgatgttgtaaaacctggcggcagcgcaaaagatg

SEQ ID NO: 240961 - DNA, 103 bp, Artificial Sequence
  Synthetic Polynucleotide
taatacgactcactatagggcactgattacacttaaagggggttacaacaaacagaggagatgttgtatgcccctttaaaacctggcggcagcgcaaaagatg

SEQ ID NO: 240962 - DNA, 103 bp, Artificial Sequence
  Synthetic Polynucleotide
taatacgactcactataggggtcttgtccacactgattacacttaaagggaacagaggagaccctttatgtgtaatcagaacctggcggcagcgcaaaagatg

SEQ ID NO: 240963 - DNA, 103 bp, Artificial Sequence
  Synthetic Polynucleotide
taatacgactcactatagggtatgactgaagtcttgtccacactgattacaacagaggagagtaatcatggtggacaagaacctggcggcagcgcaaaagatg

SEQ ID NO: 240964 - DNA, 103 bp, Artificial Sequence
  Synthetic Polynucleotide
taatacgactcactatagggaggtcaaatttatgactgaagtcttgtccaaacagaggagatggacaatgcttcagtcaaacctggcggcagcgcaaaagatg

SEQ ID NO: 240965 - DNA, 103 bp, Artificial Sequence
  Synthetic Polynucleotide
taatacgactcactatagggttgagaacaccaagctttcctttccatcataacagaggagaatgatgatgaggaaagctaacctggcggcagcgcaaaagatg

SEQ ID NO: 240966 - DNA, 103 bp, Artificial Sequence
  Synthetic Polynucleotide
taatacgactcactatagggatgtctaatgaggtcaaatttatgactgaaaacagaggagattcagtatgaaatttgacaacctggcggcagcgcaaaagatg

SEQ ID NO: 240967 - DNA, 103 bp, Artificial Sequence
  Synthetic Polynucleotide
taatacgactcactataggggaattcgctcatgtctaatgaggtcaaattaacagaggagaaatttgatgtcattagacaacctggcggcagcgcaaaagatg

SEQ ID NO: 240968 - DNA, 103 bp, Artificial Sequence
  Synthetic Polynucleotide
taatacgactcactatagggtctccagcatgaattcgctcatgtctaatgaacagaggagacattagatgtgagcgaataacctggcggcagcgcaaaagatg

SEQ ID NO: 240969 - DNA, 103 bp, Artificial Sequence
  Synthetic Polynucleotide
taatacgactcactataggggtaaggtttctctccagcatgaattcgctcaacagaggagagagcgaatgcatgctggaaacctggcggcagcgcaaaagatg

SEQ ID NO: 240970 - DNA, 103 bp, Artificial Sequence
  Synthetic Polynucleotide
taatacgactcactatagggctttacattcgtaaggtttctctccagcataacagaggagaatgctgatgagaaaccttaacctggcggcagcgcaaaagatg

SEQ ID NO: 240971 - DNA, 103 bp, Artificial Sequence
  Synthetic Polynucleotide
taatacgactcactatagggtttccacattctttacattcgtaaggtttcaacagaggagagaaaccatgcgaatgtaaaacctggcggcagcgcaaaagatg

SEQ ID NO: 240972 - DNA, 103 bp, Artificial Sequence
  Synthetic Polynucleotide
taatacgactcactatagggactgaaggcttttccacattctttacattcaacagaggagagaatgtatggaatgtggaaacctggcggcagcgcaaaagatg

SEQ ID NO: 240973 - DNA, 103 bp, Artificial Sequence
  Synthetic Polynucleotide
taatacgactcactatagggtttccttcctactgaaggcttttccacattaacagaggagaaatgtgatgaagccttcaaacctggcggcagcgcaaaagatg

SEQ ID NO: 240974 - DNA, 103 bp, Artificial Sequence
  Synthetic Polynucleotide
taatacgactcactataggggtaataagattttccttcctactgaaggctaacagaggagaagccttatgtaggaaggaaacctggcggcagcgcaaaagatg

SEQ ID NO: 240975 - DNA, 103 bp, Artificial Sequence
  Synthetic Polynucleotide
taatacgactcactatagggtttctgatgtgtaataagattttccttcctaacagaggagaaggaagatgaatcttattaacctggcggcagcgcaaaagatg

SEQ ID NO: 240976 - DNA, 103 bp, Artificial Sequence
  Synthetic Polynucleotide
taatacgactcactataggggggcagactcttgagaacaccaagctttccaacagaggagaggaaagatgggtgttctcaacctggcggcagcgcaaaagatg

SEQ ID NO: 240977 - DNA, 103 bp, Artificial Sequence
  Synthetic Polynucleotide
taatacgactcactatagggcagtatgaattttctgatgtgtaataagataacagaggagaatcttaatgcacatcagaaacctggcggcagcgcaaaagatg

SEQ ID NO: 240978 - DNA, 103 bp, Artificial Sequence
  Synthetic Polynucleotide
taatacgactcactatagggggtttttccccagtatgaattttctgatgtaacagaggagaacatcaatgaattcatacaacctggcggcagcgcaaaagatg

SEQ ID NO: 240979 - DNA, 103 bp, Artificial Sequence
  Synthetic Polynucleotide
taatacgactcactatagggacacttatacggtttttccccagtatgaataacagaggagaattcatatgggggaaaaaaacctggcggcagcgcaaaagatg

SEQ ID NO: 240980 - DNA, 103 bp, Artificial Sequence
  Synthetic Polynucleotide
taatacgactcactatagggcacattcattacacttatacggtttttcccaacagaggagagggaaaatgcgtataagtaacctggcggcagcgcaaaagatg

SEQ ID NO: 240981 - DNA, 103 bp, Artificial Sequence
  Synthetic Polynucleotide
taatacgactcactatagggaaagcttttccacattcattacacttatacaacagaggagagtataaatgtaatgaatgaacctggcggcagcgcaaaagatg

SEQ ID NO: 240982 - DNA, 103 bp, Artificial Sequence
  Synthetic Polynucleotide
taatacgactcactatagggcatctgaatgaaagcttttccacattcattaacagaggagaaatgaaatgggaaaagctaacctggcggcagcgcaaaagatg

SEQ ID NO: 240983 - DNA, 103 bp, Artificial Sequence
  Synthetic Polynucleotide
taatacgactcactatagggtaaggtttgacatctgaatgaaagcttttcaacagaggagagaaaagatgtcattcagaaacctggcggcagcgcaaaagatg

SEQ ID NO: 240984 - DNA, 103 bp, Artificial Sequence
  Synthetic Polynucleotide
taatacgactcactatagggtggtgtctaataaggtttgacatctgaatgaacagaggagacattcaatggtcaaacctaacctggcggcagcgcaaaagatg

SEQ ID NO: 240985 - DNA, 103 bp, Artificial Sequence
  Synthetic Polynucleotide
taatacgactcactatagggatgaattctgtggtgtctaataaggtttgaaacagaggagatcaaacatgattagacacaacctggcggcagcgcaaaagatg

SEQ ID NO: 240986 - DNA, 103 bp, Artificial Sequence
  Synthetic Polynucleotide
taatacgactcactatagggtctccccagtatgaattctgtggtgtctaaaacagaggagattagacatgacagaattcaacctggcggcagcgcaaaagatg

SEQ ID NO: 240987 - DNA, 103 bp, Artificial Sequence
  Synthetic Polynucleotide
taatacgactcactatagggtcctcggaaagggcagactcttgagaacacaacagaggagagtgttcatgagagtctgcaacctggcggcagcgcaaaagatg

SEQ ID NO: 240988 - DNA, 103 bp, Artificial Sequence
  Synthetic Polynucleotide
taatacgactcactataggggcataaggtttctccccagtatgaattctgaacagaggagacagaatatgtactggggaaacctggcggcagcgcaaaagatg

SEQ ID NO: 240989 - DNA, 103 bp, Artificial Sequence
  Synthetic Polynucleotide
taatacgactcactatagggatccttacatgcataaggtttctccccagtaacagaggagaactgggatgaaaccttataacctggcggcagcgcaaaagatg

SEQ ID NO: 240990 - DNA, 103 bp, Artificial Sequence
  Synthetic Polynucleotide
taatacgactcactatagggctttccaacaatccttacatgcataaggttaacagaggagaaaccttatgcatgtaaggaacctggcggcagcgcaaaagatg

SEQ ID NO: 240991 - DNA, 103 bp, Artificial Sequence
  Synthetic Polynucleotide
taatacgactcactatagggtgactgaaggctttccaacaatccttacataacagaggagaatgtaaatgttgttggaaaacctggcggcagcgcaaaagatg

SEQ ID NO: 240992 - DNA, 103 bp, Artificial Sequence
  Synthetic Polynucleotide
taatacgactcactatagggatttgatttctgactgaaggctttccaacaaacagaggagatgttggatggccttcagtaacctggcggcagcgcaaaagatg

SEQ ID NO: 240993 - DNA, 103 bp, Artificial Sequence
  Synthetic Polynucleotide
taatacgactcactataggggttcaatgagatttgatttctgactgaaggaacagaggagaccttcaatgagaaatcaaaacctggcggcagcgcaaaagatg

SEQ ID NO: 240994 - DNA, 103 bp, Artificial Sequence
  Synthetic Polynucleotide
taatacgactcactatagggattcgctcatgttcaatgagatttgatttcaacagaggagagaaatcatgtctcattgaaacctggcggcagcgcaaaagatg

SEQ ID NO: 240995 - DNA, 103 bp, Artificial Sequence
  Synthetic Polynucleotide
taatacgactcactatagggtccagtgtgaattcgctcatgttcaatgagaacagaggagactcattatgcatgagcgaaacctggcggcagcgcaaaagatg

SEQ ID NO: 240996 - DNA, 103 bp, Artificial Sequence
  Synthetic Polynucleotide
taatacgactcactatagggagggtttctctccagtgtgaattcgctcataacagaggagaatgagcatgttcacactgaacctggcggcagcgcaaaagatg

SEQ ID NO: 240997 - DNA, 103 bp, Artificial Sequence
  Synthetic Polynucleotide
taatacgactcactatagggttacattcatagggtttctctccagtgtgaaacagaggagatcacacatgagagaaaccaacctggcggcagcgcaaaagatg

SEQ ID NO: 240998 - DNA, 103 bp, Artificial Sequence
  Synthetic Polynucleotide
taatacgactcactataggggcccagtagctgctcccgcggggcccacataacagaggagaatgtggatgccgcgggagaacctggcggcagcgcaaaagatg

SEQ ID NO: 240999 - DNA, 103 bp, Artificial Sequence
  Synthetic Polynucleotide
taatacgactcactatagggcacatcctcgaaagtcactggtcccagataaacagaggagatatctgatgccagtgactaacctggcggcagcgcaaaagatg

SEQ ID NO: 241000 - DNA, 103 bp, Artificial Sequence
  Synthetic Polynucleotide
taatacgactcactataggggcctcgcccacacactgtgcacataaacgaaacagaggagatcgtttatgtgcacagtgaacctggcggcagcgcaaaagatg

SEQ ID NO: 241001 - DNA, 103 bp, Artificial Sequence
  Synthetic Polynucleotide
taatacgactcactatagggtttcacgaaagcctcgcccacacactgtgcaacagaggagagcacagatggtgggcgagaacctggcggcagcgcaaaagatg

SEQ ID NO: 241002 - DNA, 103 bp, Artificial Sequence
  Synthetic Polynucleotide
taatacgactcactatagggagctctgacttttcacgaaagcctcgcccaaacagaggagatgggcgatgctttcgtgaaacctggcggcagcgcaaaagatg

SEQ ID NO: 241003 - DNA, 103 bp, Artificial Sequence
  Synthetic Polynucleotide
taatacgactcactataggggtgcttaatgagctctgacttttcacgaaaaacagaggagatttcgtatgaagtcagagaacctggcggcagcgcaaaagatg

SEQ ID NO: 241004 - DNA, 103 bp, Artificial Sequence
  Synthetic Polynucleotide
taatacgactcactataggggaattctctggtgcttaatgagctctgactaacagaggagaagtcagatgtcattaagcaacctggcggcagcgcaaaagatg

SEQ ID NO: 241005 - DNA, 103 bp, Artificial Sequence
  Synthetic Polynucleotide
taatacgactcactatagggtcccccgtgtgaattctctggtgcttaatgaacagaggagacattaaatgccagagaataacctggcggcagcgcaaaagatg

SEQ ID NO: 241006 - DNA, 103 bp, Artificial Sequence
  Synthetic Polynucleotide
taatacgactcactatagggataaggcttatcccccgtgtgaattctctgaacagaggagacagagaatgcacacggggaacctggcggcagcgcaaaagatg

SEQ ID NO: 241007 - DNA, 103 bp, Artificial Sequence
  Synthetic Polynucleotide
taatacgactcactatagggctctgcacacataaggcttatcccccgtgtaacagaggagaacacggatgataagccttaacctggcggcagcgcaaaagatg

SEQ ID NO: 241008 - DNA, 103 bp, Artificial Sequence
  Synthetic Polynucleotide
taatacgactcactatagggaaagcacagccacatcctcgaaagtcactgaacagaggagacagtgaatgtcgaggatgaacctggcggcagcgcaaaagatg

SEQ ID NO: 241009 - DNA, 103 bp, Artificial Sequence
  Synthetic Polynucleotide
taatacgactcactataggggcctcagtgaaaagcacagccacatcctcgaacagaggagacgaggaatgggctgtgctaacctggcggcagcgcaaaagatg

SEQ ID NO: 241010 - DNA, 103 bp, Artificial Sequence
  Synthetic Polynucleotide
taatacgactcactatagggcttccactctgcctcagtgaaaagcacagcaacagaggagagctgtgatgttcactgagaacctggcggcagcgcaaaagatg

SEQ ID NO: 241011 - DNA, 103 bp, Artificial Sequence
  Synthetic Polynucleotide
taatacgactcactatagggggctcagtctcttccactctgcctcagtgaaacagaggagatcactgatgcagagtggaaacctggcggcagcgcaaaagatg

SEQ ID NO: 241012 - DNA, 103 bp, Artificial Sequence
  Synthetic Polynucleotide
taatacgactcactatagggctctgctcaaggctcagtctcttccactctaacagaggagaagagtgatggagactgagaacctggcggcagcgcaaaagatg

SEQ ID NO: 241013 - DNA, 103 bp, Artificial Sequence
  Synthetic Polynucleotide
taatacgactcactataggggtataggttcctctgctcaaggctcagtctaacagaggagaagactgatgcttgagcagaacctggcggcagcgcaaaagatg

SEQ ID NO: 241014 - DNA, 103 bp, Artificial Sequence
  Synthetic Polynucleotide
taatacgactcactatagggtcacttctttgtataggttcctctgctcaaaacagaggagattgagcatgggaacctataacctggcggcagcgcaaaagatg

SEQ ID NO: 241015 - DNA, 103 bp, Artificial Sequence
  Synthetic Polynucleotide
taatacgactcactatagggttttccagcatcacttctttgtataggttcaacagaggagagaacctatgcaaagaagtaacctggcggcagcgcaaaagatg

SEQ ID NO: 241016 - DNA, 103 bp, Artificial Sequence
  Synthetic Polynucleotide
taatacgactcactatagggattcctgagattttccagcatcacttctttaacagaggagaaaagaaatgatgctggaaaacctggcggcagcgcaaaagatg

SEQ ID NO: 241017 - DNA, 103 bp, Artificial Sequence
  Synthetic Polynucleotide
taatacgactcactatagggccgcagtccagcccagtagctgctcccgcgaacagaggagacgcgggatgagctactggaacctggcggcagcgcaaaagatg

SEQ ID NO: 241018 - DNA, 103 bp, Artificial Sequence
  Synthetic Polynucleotide
taatacgactcactatagggatgagaccagattcctgagattttccagcaaacagaggagatgctggatgatctcaggaaacctggcggcagcgcaaaagatg

SEQ ID NO: 241019 - DNA, 103 bp, Artificial Sequence
  Synthetic Polynucleotide
taatacgactcactataggggattctgccaatgagaccagattcctgagaaacagaggagatctcagatgtctggtctcaacctggcggcagcgcaaaagatg

SEQ ID NO: 241020 - DNA, 103 bp, Artificial Sequence
  Synthetic Polynucleotide
taatacgactcactatagggttctggctttgattctgccaatgagaccagaacagaggagactggtcatgttggcagaaaacctggcggcagcgcaaaagatg

SEQ ID NO: 241021 - DNA, 103 bp, Artificial Sequence
  Synthetic Polynucleotide
taatacgactcactatagggaggtatggacttctggctttgattctgccaaacagaggagatggcagatgcaaagccagaacctggcggcagcgcaaaagatg

SEQ ID NO: 241022 - DNA, 103 bp, Artificial Sequence
  Synthetic Polynucleotide
taatacgactcactatagggcaagaagggcaggtatggacttctggctttaacagaggagaaaagccatgagtccatacaacctggcggcagcgcaaaagatg

SEQ ID NO: 241023 - DNA, 103 bp, Artificial Sequence
  Synthetic Polynucleotide
taatacgactcactatagggggccagagggcaagaagggcaggtatggacaacagaggagagtccatatgtgcccttctaacctggcggcagcgcaaaagatg

SEQ ID NO: 241024 - DNA, 103 bp, Artificial Sequence
  Synthetic Polynucleotide
taatacgactcactataggggactgccaaaggccagagggcaagaagggcaacagaggagagcccttatggccctctggaacctggcggcagcgcaaaagatg

SEQ ID NO: 241025 - DNA, 103 bp, Artificial Sequence
  Synthetic Polynucleotide
taatacgactcactatagggaggaactgctgactgccaaaggccagagggaacagaggagaccctctatgctttggcagaacctggcggcagcgcaaaagatg

SEQ ID NO: 241026 - DNA, 103 bp, Artificial Sequence
  Synthetic Polynucleotide
taatacgactcactatagggatcttggctgaggaactgctgactgccaaaaacagaggagatttggcatgcagcagttcaacctggcggcagcgcaaaagatg

SEQ ID NO: 241027 - DNA, 103 bp, Artificial Sequence
  Synthetic Polynucleotide
taatacgactcactatagggtgtgtagctcatcttggctgaggaactgctaacagaggagaagcagtatgtcagccaagaacctggcggcagcgcaaaagatg

SEQ ID NO: 241028 - DNA, 103 bp, Artificial Sequence
  Synthetic Polynucleotide
taatacgactcactatagggggcagagcttccgcagtccagcccagtagcaacagaggagagctactatgctggactgcaacctggcggcagcgcaaaagatg

SEQ ID NO: 241029 - DNA, 103 bp, Artificial Sequence
  Synthetic Polynucleotide
taatacgactcactatagggataggatgattgtgtagctcatcttggctgaacagaggagacagccaatgtgagctacaaacctggcggcagcgcaaaagatg

SEQ ID NO: 241030 - DNA, 103 bp, Artificial Sequence
  Synthetic Polynucleotide
taatacgactcactataggggaaacctggaataggatgattgtgtagctcaacagaggagagagctaatgaatcatcctaacctggcggcagcgcaaaagatg

SEQ ID NO: 241031 - DNA, 103 bp, Artificial Sequence
  Synthetic Polynucleotide
taatacgactcactatagggttcctgcatggaaacctggaataggatgataacagaggagaatcatcatgttccaggttaacctggcggcagcgcaaaagatg

SEQ ID NO: 241032 - DNA, 103 bp, Artificial Sequence
  Synthetic Polynucleotide
taatacgactcactatagggtggagttgatttcctgcatggaaacctggaaacagaggagatccaggatgccatgcaggaacctggcggcagcgcaaaagatg

SEQ ID NO: 241033 - DNA, 103 bp, Artificial Sequence
  Synthetic Polynucleotide
taatacgactcactatagggatttcctgggtggagttgatttcctgcatgaacagaggagacatgcaatgaatcaactcaacctggcggcagcgcaaaagatg

SEQ ID NO: 241034 - DNA, 103 bp, Artificial Sequence
  Synthetic Polynucleotide
taatacgactcactatagggctgggcagggatttcctgggtggagttgataacagaggagaatcaacatgacccaggaaaacctggcggcagcgcaaaagatg

SEQ ID NO: 241035 - DNA, 103 bp, Artificial Sequence
  Synthetic Polynucleotide
taatacgactcactatagggggctgatcctctgggcagggatttcctgggaacagaggagacccaggatgtccctgcccaacctggcggcagcgcaaaagatg

SEQ ID NO: 241036 - DNA, 103 bp, Artificial Sequence
  Synthetic Polynucleotide
taatacgactcactatagggttgtgactgtggctgatcctctgggcagggaacagaggagaccctgcatggaggatcagaacctggcggcagcgcaaaagatg

SEQ ID NO: 241037 - DNA, 103 bp, Artificial Sequence
  Synthetic Polynucleotide
taatacgactcactatagggcagaaggatgttgtgactgtggctgatcctaacagaggagaaggatcatgcacagtcacaacctggcggcagcgcaaaagatg

SEQ ID NO: 241038 - DNA, 103 bp, Artificial Sequence
  Synthetic Polynucleotide
taatacgactcactatagggtgatttttatcagaaggatgttgtgactgtaacagaggagaacagtcatgacatccttcaacctggcggcagcgcaaaagatg

SEQ ID NO: 241039 - DNA, 103 bp, Artificial Sequence
  Synthetic Polynucleotide
taatacgactcactatagggatccttggcaggcagagcttccgcagtccaaacagaggagatggactatggaagctctgaacctggcggcagcgcaaaagatg

SEQ ID NO: 241040 - DNA, 103 bp, Artificial Sequence
  Synthetic Polynucleotide
taatacgactcactatagggagcccccctgtgatttttatcagaaggatgaacagaggagacatcctatggataaaaataacctggcggcagcgcaaaagatg

SEQ ID NO: 241041 - DNA, 103 bp, Artificial Sequence
  Synthetic Polynucleotide
taatacgactcactatagggcttctgcttcagcccccctgtgatttttataacagaggagaataaaaatgacaggggggaacctggcggcagcgcaaaagatg

SEQ ID NO: 241042 - DNA, 103 bp, Artificial Sequence
  Synthetic Polynucleotide
taatacgactcactatagggactcgttgatcttctgcttcagcccccctgaacagaggagacaggggatgtgaagcagaaacctggcggcagcgcaaaagatg

SEQ ID NO: 241043 - DNA, 103 bp, Artificial Sequence
  Synthetic Polynucleotide
taatacgactcactataggggcctccttccactcgttgatcttctgcttcaacagaggagagaagcaatggatcaacgaaacctggcggcagcgcaaaagatg

SEQ ID NO: 241044 - DNA, 103 bp, Artificial Sequence
  Synthetic Polynucleotide
taatacgactcactatagggagggtctgacgcctccttccactcgttgataacagaggagaatcaacatgtggaaggagaacctggcggcagcgcaaaagatg

SEQ ID NO: 241045 - DNA, 103 bp, Artificial Sequence
  Synthetic Polynucleotide
taatacgactcactatagggctccaaaacaagggtctgacgcctccttccaacagaggagaggaaggatgcgtcagaccaacctggcggcagcgcaaaagatg

SEQ ID NO: 241046 - DNA, 103 bp, Artificial Sequence
  Synthetic Polynucleotide
taatacgactcactatagggttcatttgtactccaaaacaagggtctgacaacagaggagagtcagaatgttgttttggaacctggcggcagcgcaaaagatg

SEQ ID NO: 241047 - DNA, 103 bp, Artificial Sequence
  Synthetic Polynucleotide
taatacgactcactatagggaagcccccctttcatttgtactccaaaacaaacagaggagatgttttatggtacaaatgaacctggcggcagcgcaaaagatg

SEQ ID NO: 241048 - DNA, 103 bp, Artificial Sequence
  Synthetic Polynucleotide
taatacgactcactatagggaaacccactaaagcccccctttcatttgtaaacagaggagatacaaaatgaaggggggcaacctggcggcagcgcaaaagatg

SEQ ID NO: 241049 - DNA, 103 bp, Artificial Sequence
  Synthetic Polynucleotide
taatacgactcactatagggcaggctagagaaacccactaaagcccccctaacagaggagaagggggatgttagtgggtaacctggcggcagcgcaaaagatg

SEQ ID NO: 241050 - DNA, 103 bp, Artificial Sequence
  Synthetic Polynucleotide
taatacgactcactataggggccaggcagaatccttggcaggcagagcttaacagaggagaaagctcatgctgccaaggaacctggcggcagcgcaaaagatg

SEQ ID NO: 241051 - DNA, 103 bp, Artificial Sequence
  Synthetic Polynucleotide
taatacgactcactataggggtctctggaacaggctagagaaacccactaaacagaggagatagtggatgtctctagccaacctggcggcagcgcaaaagatg

SEQ ID NO: 241052 - DNA, 103 bp, Artificial Sequence
  Synthetic Polynucleotide
taatacgactcactatagggcttattggtggtctctggaacaggctagagaacagaggagactctagatggttccagagaacctggcggcagcgcaaaagatg

SEQ ID NO: 241053 - DNA, 103 bp, Artificial Sequence
  Synthetic Polynucleotide
taatacgactcactatagggtccccaagagcttattggtggtctctggaaaacagaggagattccagatgccaccaataaacctggcggcagcgcaaaagatg

SEQ ID NO: 241054 - DNA, 103 bp, Artificial Sequence
  Synthetic Polynucleotide
taatacgactcactatagggttctgttgcctccccaagagcttattggtgaacagaggagacaccaaatggctcttgggaacctggcggcagcgcaaaagatg

SEQ ID NO: 241055 - DNA, 103 bp, Artificial Sequence
  Synthetic Polynucleotide
taatacgactcactatagggatctctaatattctgttgcctccccaagagaacagaggagactcttgatgaggcaacagaacctggcggcagcgcaaaagatg

SEQ ID NO: 241056 - DNA, 103 bp, Artificial Sequence
  Synthetic Polynucleotide
taatacgactcactatagggactgagctgtatctctaatattctgttgccaacagaggagaggcaacatgatattagagaacctggcggcagcgcaaaagatg

SEQ ID NO: 241057 - DNA, 103 bp, Artificial Sequence
  Synthetic Polynucleotide
taatacgactcactatagggtctgggctggactgagctgtatctctaataaacagaggagatattagatgtacagctcaaacctggcggcagcgcaaaagatg

SEQ ID NO: 241058 - DNA, 103 bp, Artificial Sequence
  Synthetic Polynucleotide
taatacgactcactataggggagcttgcattctgggctggactgagctgtaacagaggagaacagctatgtccagcccaaacctggcggcagcgcaaaagatg

SEQ ID NO: 241059 - DNA, 103 bp, Artificial Sequence
  Synthetic Polynucleotide
taatacgactcactatagggtacttcctcagagcttgcattctgggctggaacagaggagaccagccatgaatgcaagcaacctggcggcagcgcaaaagatg

SEQ ID NO: 241060 - DNA, 103 bp, Artificial Sequence
  Synthetic Polynucleotide
taatacgactcactatagggaaattctgtctacttcctcagagcttgcataacagaggagaatgcaaatgctgaggaagaacctggcggcagcgcaaaagatg

SEQ ID NO: 241061 - DNA, 103 bp, Artificial Sequence
  Synthetic Polynucleotide
taatacgactcactatagggtcttcccagggccaggcagaatccttggcaaacagaggagatgccaaatgttctgcctgaacctggcggcagcgcaaaagatg

SEQ ID NO: 241062 - DNA, 103 bp, Artificial Sequence
  Synthetic Polynucleotide
taatacgactcactataggggccctcttggaaattctgtctacttcctcaaacagaggagatgaggaatgagacagaataacctggcggcagcgcaaaagatg

SEQ ID NO: 241063 - DNA, 103 bp, Artificial Sequence
  Synthetic Polynucleotide
taatacgactcactatagggtggggtttctgccctcttggaaattctgtcaacagaggagagacagaatgtccaagaggaacctggcggcagcgcaaaagatg

SEQ ID NO: 241064 - DNA, 103 bp, Artificial Sequence
  Synthetic Polynucleotide
taatacgactcactatagggctccaaaccctggggtttctgccctcttggaacagaggagaccaagaatgcagaaacccaacctggcggcagcgcaaaagatg

SEQ ID NO: 241065 - DNA, 103 bp, Artificial Sequence
  Synthetic Polynucleotide
taatacgactcactatagggaacgtgactgctccaaaccctggggtttctaacagaggagaagaaacatgagggtttggaacctggcggcagcgcaaaagatg

SEQ ID NO: 241066 - DNA, 103 bp, Artificial Sequence
  Synthetic Polynucleotide
taatacgactcactatagggacactccccaaacgtgactgctccaaacccaacagaggagagggtttatggcagtcacgaacctggcggcagcgcaaaagatg

SEQ ID NO: 241067 - DNA, 103 bp, Artificial Sequence
  Synthetic Polynucleotide
taatacgactcactatagggaagctagtgcacactccccaaacgtgactgaacagaggagacagtcaatgttggggagtaacctggcggcagcgcaaaagatg

SEQ ID NO: 241068 - DNA, 103 bp, Artificial Sequence
  Synthetic Polynucleotide
taatacgactcactatagggttctggttaaaagctagtgcacactccccaaacagaggagatggggaatgtgcactagcaacctggcggcagcgcaaaagatg

SEQ ID NO: 241069 - DNA, 103 bp, Artificial Sequence
  Synthetic Polynucleotide
taatacgactcactatagggcaggtttgacttctggttaaaagctagtgcaacagaggagagcactaatgtttaaccagaacctggcggcagcgcaaaagatg

SEQ ID NO: 241070 - DNA, 103 bp, Artificial Sequence
  Synthetic Polynucleotide
taatacgactcactatagggtctgtctgaacaggtttgacttctggttaaaacagaggagattaaccatgagtcaaaccaacctggcggcagcgcaaaagatg

SEQ ID NO: 241071 - DNA, 103 bp, Artificial Sequence
  Synthetic Polynucleotide
taatacgactcactataggggtgactgccttctgtctgaacaggtttgacaacagaggagagtcaaaatggttcagacaaacctggcggcagcgcaaaagatg

SEQ ID NO: 241072 - DNA, 103 bp, Artificial Sequence
  Synthetic Polynucleotide
taatacgactcactatagggtctaggcttctcttcccagggccaggcagaaacagaggagatctgccatgccctgggaaaacctggcggcagcgcaaaagatg

SEQ ID NO: 241073 - DNA, 103 bp, Artificial Sequence
  Synthetic Polynucleotide
taatacgactcactatagggtttttctgctgtgactgccttctgtctgaaaacagaggagattcagaatgaaggcagtcaacctggcggcagcgcaaaagatg

SEQ ID NO: 241074 - DNA, 103 bp, Artificial Sequence
  Synthetic Polynucleotide
taatacgactcactatagggtgtctgaagatttttctgctgtgactgcctaacagaggagaaggcagatgcagcagaaaaacctggcggcagcgcaaaagatg

SEQ ID NO: 241075 - DNA, 103 bp, Artificial Sequence
  Synthetic Polynucleotide
taatacgactcactataggggactgccttttgtctgaagatttttctgctaacagaggagaagcagaatgatcttcagaaacctggcggcagcgcaaaagatg

SEQ ID NO: 241076 - DNA, 103 bp, Artificial Sequence
  Synthetic Polynucleotide
taatacgactcactataggggcacacctgtgactgccttttgtctgaagaaacagaggagatcttcaatgaaaaggcagaacctggcggcagcgcaaaagatg

SEQ ID NO: 241077 - DNA, 103 bp, Artificial Sequence
  Synthetic Polynucleotide
taatacgactcactatagggcacactccctgcacacctgtgactgcctttaacagaggagaaaaggcatgcacaggtgtaacctggcggcagcgcaaaagatg

SEQ ID NO: 241078 - DNA, 103 bp, Artificial Sequence
  Synthetic Polynucleotide
taatacgactcactatagggaagcctcgcccacactccctgcacacctgtaacagaggagaacaggtatgcagggagtgaacctggcggcagcgcaaaagatg

SEQ ID NO: 241079 - DNA, 103 bp, Artificial Sequence
  Synthetic Polynucleotide
taatacgactcactatagggcttcctgctaaagcctcgcccacactccctaacagaggagaagggagatggggcgaggcaacctggcggcagcgcaaaagatg

SEQ ID NO: 241080 - DNA, 103 bp, Artificial Sequence
  Synthetic Polynucleotide
taatacgactcactatagggtgagctgtgacttcctgctaaagcctcgccaacagaggagaggcgagatgttagcaggaaacctggcggcagcgcaaaagatg

SEQ ID NO: 241081 - DNA, 103 bp, Artificial Sequence
  Synthetic Polynucleotide
taatacgactcactatagggtggtgtatgatgagctgtgacttcctgctaaacagaggagatagcagatggtcacagctaacctggcggcagcgcaaaagatg

SEQ ID NO: 241082 - DNA, 103 bp, Artificial Sequence
  Synthetic Polynucleotide
taatacgactcactataggggtgtgtcctctggtgtatgatgagctgtgaaacagaggagatcacagatgatcatacacaacctggcggcagcgcaaaagatg

SEQ ID NO: 241083 - DNA, 103 bp, Artificial Sequence
  Synthetic Polynucleotide
taatacgactcactataggggtcccagatatctaggcttctcttcccaggaacagaggagacctgggatgagaagcctaaacctggcggcagcgcaaaagatg

SEQ ID NO: 241084 - DNA, 103 bp, Artificial Sequence
  Synthetic Polynucleotide
taatacgactcactatagggtttctcctgtgtgtgtcctctggtgtatgaaacagaggagatcatacatgagaggacacaacctggcggcagcgcaaaagatg

SEQ ID NO: 241085 - DNA, 103 bp, Artificial Sequence
  Synthetic Polynucleotide
taatacgactcactatagggacataaggcttttctcctgtgtgtgtcctcaacagaggagagaggacatgcacaggagaaacctggcggcagcgcaaaagatg

SEQ ID NO: 241086 - DNA, 103 bp, Artificial Sequence
  Synthetic Polynucleotide
taatacgactcactatagggctctccgcagacataaggcttttctcctgtaacagaggagaacaggaatgaagccttataacctggcggcagcgcaaaagatg

SEQ ID NO: 241087 - DNA, 103 bp, Artificial Sequence
  Synthetic Polynucleotide
taatacgactcactatagggctcgcccacactctccgcagacataaggctaacagaggagaagccttatgtctgcggagaacctggcggcagcgcaaaagatg

SEQ ID NO: 241088 - DNA, 103 bp, Artificial Sequence
  Synthetic Polynucleotide
taatacgactcactatagggactataaagcctcgcccacactctccgcagaacagaggagactgcggatggtgtgggcgaacctggcggcagcgcaaaagatg

SEQ ID NO: 241089 - DNA, 103 bp, Artificial Sequence
  Synthetic Polynucleotide
taatacgactcactataggggactgactcaactataaagcctcgcccacaaacagaggagatgtgggatgggctttataaacctggcggcagcgcaaaagatg

SEQ ID NO: 241090 - DNA, 103 bp, Artificial Sequence
  Synthetic Polynucleotide
taatacgactcactatagggggttgcggaggactgactcaactataaagcaacagaggagagctttaatgttgagtcagaacctggcggcagcgcaaaagatg

SEQ ID NO: 241091 - DNA, 103 bp, Artificial Sequence
  Synthetic Polynucleotide
taatacgactcactataggggtactcaggtggttgcggaggactgactcaaacagaggagatgagtcatgcctccgcaaaacctggcggcagcgcaaaagatg

SEQ ID NO: 241092 - DNA, 103 bp, Artificial Sequence
  Synthetic Polynucleotide
taatacgactcactatagggcccggagtgtgtactcaggtggttgcggagaacagaggagactccgcatgcacctgagtaacctggcggcagcgcaaaagatg

SEQ ID NO: 241093 - DNA, 103 bp, Artificial Sequence
  Synthetic Polynucleotide
taatacgactcactatagggaaggtttctccccggagtgtgtactcaggtaacagaggagaacctgaatgcacactccgaacctggcggcagcgcaaaagatg

SEQ ID NO: 241094 - DNA, 103 bp, Artificial Sequence
  Synthetic Polynucleotide
taatacgactcactatagggaaagtcactggtcccagatatctaggcttcaacagaggagagaagccatgatatctgggaacctggcggcagcgcaaaagatg

SEQ ID NO: 241095 - DNA, 103 bp, Artificial Sequence
  Synthetic Polynucleotide
taatacgactcactatagggctgcacacataaggtttctccccggagtgtaacagaggagaacactcatgggagaaaccaacctggcggcagcgcaaaagatg

SEQ ID NO: 241096 - DNA, 103 bp, Artificial Sequence
  Synthetic Polynucleotide
taatacgactcactatagggcccacaatggctgcacacataaggtttctcaacagaggagagagaaaatgtatgtgtgcaacctggcggcagcgcaaaagatg

SEQ ID NO: 241097 - DNA, 103 bp, Artificial Sequence
  Synthetic Polynucleotide
taatacgactcactatagggtaaagcctcgcccacaatggctgcacacataacagaggagaatgtgtatggccattgtgaacctggcggcagcgcaaaagatg

SEQ ID NO: 241098 - DNA, 103 bp, Artificial Sequence
  Synthetic Polynucleotide
taatacgactcactatagggggcttgcagctaaagcctcgcccacaatggaacagaggagaccattgatggcgaggcttaacctggcggcagcgcaaaagatg

SEQ ID NO: 241099 - DNA, 103 bp, Artificial Sequence
  Synthetic Polynucleotide
taatacgactcactataggggatgaggtatggcttgcagctaaagcctcgaacagaggagacgaggcatgagctgcaagaacctggcggcagcgcaaaagatg

SEQ ID NO: 241100 - DNA, 103 bp, Artificial Sequence
  Synthetic Polynucleotide
taatacgactcactatagggtctgatgtctgatgaggtatggcttgcagcaacagaggagagctgcaatgcatacctcaaacctggcggcagcgcaaaagatg

SEQ ID NO: 241101 - DNA, 103 bp, Artificial Sequence
  Synthetic Polynucleotide
taatacgactcactataggggtgtgtgtcctctgatgtctgatgaggtataacagaggagaatacctatgcagacatcaaacctggcggcagcgcaaaagatg

SEQ ID NO: 241102 - DNA, 103 bp, Artificial Sequence
  Synthetic Polynucleotide
taatacgactcactatagggtttctcccttgtgtgtgtcctctgatgtctaacagaggagaagacatatgaggacacacaacctggcggcagcgcaaaagatg

SEQ ID NO: 241103 - DNA, 103 bp, Artificial Sequence
  Synthetic Polynucleotide
taatacgactcactatagggacataaacgatttctcccttgtgtgtgtccaacagaggagaggacacatgcaagggagaaacctggcggcagcgcaaaagatg

SEQ ID NO: 241104 - DNA, 103 bp, Artificial Sequence
  Synthetic Polynucleotide
taatacgactcactatagggcacactgtgcacataaacgatttctcccttaacagaggagaaagggaatgatcgtttataacctggcggcagcgcaaaagatg

SEQ ID NO: 241105 - DNA, 103 bp, Artificial Sequence
  Synthetic Polynucleotide
taatacgactcactatagggatcctcaaatgatatctgtgactggatcataacagaggagaatgatcatgtcacagataaacctggcggcagcgcaaaagatg

SEQ ID NO: 241106 - DNA, 103 bp, Artificial Sequence
  Synthetic Polynucleotide
taatacgactcactataggggctatagttctccaacatcacatctctgtaaacagaggagatacagaatggtgatgttgaacctggcggcagcgcaaaagatg

SEQ ID NO: 241107 - DNA, 103 bp, Artificial Sequence
  Synthetic Polynucleotide
taatacgactcactatagggatagggtttctctcctgtgtgcgctctctgaacagaggagacagagaatgcacacaggaaacctggcggcagcgcaaaagatg

SEQ ID NO: 241108 - DNA, 103 bp, Artificial Sequence
  Synthetic Polynucleotide
taatacgactcactataggggactacatggatagggtttctctcctgtgtaacagaggagaacacagatgagaaaccctaacctggcggcagcgcaaaagatg

SEQ ID NO: 241109 - DNA, 103 bp, Artificial Sequence
  Synthetic Polynucleotide
taatacgactcactatagggtttccacagtgactacatggatagggtttcaacagaggagagaaaccatgtccatgtagaacctggcggcagcgcaaaagatg

SEQ ID NO: 241110 - DNA, 103 bp, Artificial Sequence
  Synthetic Polynucleotide
taatacgactcactatagggaaagaaggcttttccacagtgactacatggaacagaggagaccatgtatgcactgtggaaacctggcggcagcgcaaaagatg

SEQ ID NO: 241111 - DNA, 103 bp, Artificial Sequence
  Synthetic Polynucleotide
taatacgactcactataggggcgacttccaaaagaaggcttttccacagtaacagaggagaactgtgatgaagccttctaacctggcggcagcgcaaaagatg

SEQ ID NO: 241112 - DNA, 103 bp, Artificial Sequence
  Synthetic Polynucleotide
taatacgactcactataggggtaatcagctgcgacttccaaaagaaggctaacagaggagaagccttatgttggaagtcaacctggcggcagcgcaaaagatg

SEQ ID NO: 241113 - DNA, 103 bp, Artificial Sequence
  Synthetic Polynucleotide
taatacgactcactatagggcctctgatgagtaatcagctgcgacttccaaacagaggagatggaagatgcagctgattaacctggcggcagcgcaaaagatg

SEQ ID NO: 241114 - DNA, 103 bp, Artificial Sequence
  Synthetic Polynucleotide
taatacgactcactatagggctgtgtgggtcctctgatgagtaatcagctaacagaggagaagctgaatgctcatcagaaacctggcggcagcgcaaaagatg

SEQ ID NO: 241115 - DNA, 103 bp, Artificial Sequence
  Synthetic Polynucleotide
taatacgactcactatagggggtttcttccctgtgtgggtcctctgatgaaacagaggagatcatcaatggacccacacaacctggcggcagcgcaaaagatg

SEQ ID NO: 241116 - DNA, 103 bp, Artificial Sequence
  Synthetic Polynucleotide
taatacgactcactatagggacatccgtaaggtttcttccctgtgtgggtaacagaggagaacccacatggggaagaaaaacctggcggcagcgcaaaagatg

SEQ ID NO: 241117 - DNA, 103 bp, Artificial Sequence
  Synthetic Polynucleotide
taatacgactcactatagggaaaccagattgctatagttctccaacatcaaacagaggagatgatgtatgagaactataaacctggcggcagcgcaaaagatg

SEQ ID NO: 241118 - DNA, 103 bp, Artificial Sequence
  Synthetic Polynucleotide
taatacgactcactataggggacactcaccacatccgtaaggtttcttccaacagaggagaggaagaatgcttacggataacctggcggcagcgcaaaagatg

SEQ ID NO: 241119 - DNA, 103 bp, Artificial Sequence
  Synthetic Polynucleotide
taatacgactcactatagggaaggctttttgacactcaccacatccgtaaaacagaggagattacggatgtggtgagtgaacctggcggcagcgcaaaagatg

SEQ ID NO: 241120 - DNA, 103 bp, Artificial Sequence
  Synthetic Polynucleotide
taatacgactcactataggggttcctgctgaaggctttttgacactcaccaacagaggagaggtgagatgcaaaaagccaacctggcggcagcgcaaaagatg

SEQ ID NO: 241121 - DNA, 103 bp, Artificial Sequence
  Synthetic Polynucleotide
taatacgactcactatagggtgagaagtgagttcctgctgaaggctttttaacagaggagaaaaaagatgtcagcaggaaacctggcggcagcgcaaaagatg

SEQ ID NO: 241122 - DNA, 103 bp, Artificial Sequence
  Synthetic Polynucleotide
taatacgactcactatagggtgatgcctaatgagaagtgagttcctgctgaacagaggagacagcagatgctcacttctaacctggcggcagcgcaaaagatg

SEQ ID NO: 241123 - DNA, 103 bp, Artificial Sequence
  Synthetic Polynucleotide
taatacgactcactatagggatgaatcctctgatgcctaatgagaagtgaaacagaggagatcacttatgattaggcataacctggcggcagcgcaaaagatg

SEQ ID NO: 241124 - DNA, 103 bp, Artificial Sequence
  Synthetic Polynucleotide
taatacgactcactatagggtctctcctgtatgaatcctctgatgcctaaaacagaggagattaggcatgagaggattcaacctggcggcagcgcaaaagatg

SEQ ID NO: 241125 - DNA, 103 bp, Artificial Sequence
  Synthetic Polynucleotide
taatacgactcactatagggtcgtagggcttctctcctgtatgaatcctcaacagaggagagaggatatgtacaggagaaacctggcggcagcgcaaaagatg

SEQ ID NO: 241126 - DNA, 103 bp, Artificial Sequence
  Synthetic Polynucleotide
taatacgactcactatagggttcgttgcattcgtagggcttctctcctgtaacagaggagaacaggaatgaagccctacaacctggcggcagcgcaaaagatg

SEQ ID NO: 241127 - DNA, 103 bp, Artificial Sequence
  Synthetic Polynucleotide
taatacgactcactatagggcttcaccacattcgttgcattcgtagggctaacagaggagaagccctatgaatgcaacgaacctggcggcagcgcaaaagatg

SEQ ID NO: 241128 - DNA, 103 bp, Artificial Sequence
  Synthetic Polynucleotide
taatacgactcactatagggaaacccaagaaaaccagattgctatagttcaacagaggagagaactaatgcaatctggtaacctggcggcagcgcaaaagatg

SEQ ID NO: 241129 - DNA, 103 bp, Artificial Sequence
  Synthetic Polynucleotide
taatacgactcactatagggctgatgaaggcttcaccacattcgttgcataacagaggagaatgcaaatgatgtggtgaaacctggcggcagcgcaaaagatg

SEQ ID NO: 241130 - DNA, 103 bp, Artificial Sequence
  Synthetic Polynucleotide
taatacgactcactatagggctgtggttttctgatgaaggcttcaccacaaacagaggagatgtggtatggccttcatcaacctggcggcagcgcaaaagatg

SEQ ID NO: 241131 - DNA, 103 bp, Artificial Sequence
  Synthetic Polynucleotide
taatacgactcactataggggtttaatcagctgtggttttctgatgaaggaacagaggagaccttcaatggaaaaccacaacctggcggcagcgcaaaagatg

SEQ ID NO: 241132 - DNA, 103 bp, Artificial Sequence
  Synthetic Polynucleotide
taatacgactcactataggggttatctgatgtttaatcagctgtggttttaacagaggagaaaaaccatggctgattaaaacctggcggcagcgcaaaagatg

SEQ ID NO: 241133 - DNA, 103 bp, Artificial Sequence
  Synthetic Polynucleotide
taatacgactcactatagggtcctgtgtgagttatctgatgtttaatcagaacagaggagactgattatgcatcagataaacctggcggcagcgcaaaagatg

SEQ ID NO: 241134 - DNA, 103 bp, Artificial Sequence
  Synthetic Polynucleotide
taatacgactcactatagggagttcttctctcctgtgtgagttatctgataacagaggagaatcagaatgctcacacagaacctggcggcagcgcaaaagatg

SEQ ID NO: 241135 - DNA, 103 bp, Artificial Sequence
  Synthetic Polynucleotide
taatacgactcactatagggctgcatcgatagttcttctctcctgtgtgaaacagaggagatcacacatgagagaagaaaacctggcggcagcgcaaaagatg

SEQ ID NO: 241136 - DNA, 103 bp, Artificial Sequence
  Synthetic Polynucleotide
taatacgactcactatagggctcacaatcactgcatcgatagttcttctcaacagaggagagagaagatgtatcgatgcaacctggcggcagcgcaaaagatg

SEQ ID NO: 241137 - DNA, 103 bp, Artificial Sequence
  Synthetic Polynucleotide
taatacgactcactatagggagaaggcctcctcacaatcactgcatcgataacagaggagaatcgatatggtgattgtgaacctggcggcagcgcaaaagatg

SEQ ID NO: 241138 - DNA, 103 bp, Artificial Sequence
  Synthetic Polynucleotide
taatacgactcactataggggacttcttaaagaaggcctcctcacaatcaaacagaggagatgattgatgggaggccttaacctggcggcagcgcaaaagatg

SEQ ID NO: 241139 - DNA, 103 bp, Artificial Sequence
  Synthetic Polynucleotide
taatacgactcactataggggagaatttgaaaacccaagaaaaccagattaacagaggagaaatctgatgttcttgggtaacctggcggcagcgcaaaagatg

SEQ ID NO: 241140 - DNA, 103 bp, Artificial Sequence
  Synthetic Polynucleotide
taatacgactcactatagggtattaactctgacttcttaaagaaggcctcaacagaggagagaggccatgtttaagaagaacctggcggcagcgcaaaagatg

SEQ ID NO: 241141 - DNA, 103 bp, Artificial Sequence
  Synthetic Polynucleotide
taatacgactcactatagggtttgatgtcttattaactctgacttcttaaaacagaggagattaagaatgcagagttaaaacctggcggcagcgcaaaagatg

SEQ ID NO: 241142 - DNA, 103 bp, Artificial Sequence
  Synthetic Polynucleotide
taatacgactcactatagggaagtgaattttttgatgtcttattaactctaacagaggagaagagttatgaagacatcaaacctggcggcagcgcaaaagatg

SEQ ID NO: 241143 - DNA, 103 bp, Artificial Sequence
  Synthetic Polynucleotide
taatacgactcactatagggtttctctcctaagtgaattttttgatgtctaacagaggagaagacatatgaaaattcacaacctggcggcagcgcaaaagatg

SEQ ID NO: 241144 - DNA, 103 bp, Artificial Sequence
  Synthetic Polynucleotide
taatacgactcactatagggatccatatggtttctctcctaagtgaatttaacagaggagaaaattcatgtaggagagaaacctggcggcagcgcaaaagatg

SEQ ID NO: 241145 - DNA, 103 bp, Artificial Sequence
  Synthetic Polynucleotide
taatacgactcactatagggcattgaatgcatccatatggtttctctcctaacagaggagaaggagaatgaccatatggaacctggcggcagcgcaaaagatg

SEQ ID NO: 241146 - DNA, 103 bp, Artificial Sequence
  Synthetic Polynucleotide
taatacgactcactatagggggttttcccacattgaatgcatccatatggaacagaggagaccatatatgtgcattcaaaacctggcggcagcgcaaaagatg

SEQ ID NO: 241147 - DNA, 103 bp, Artificial Sequence
  Synthetic Polynucleotide
taatacgactcactatagggtcccaaagaaggttttcccacattgaatgcaacagaggagagcattcatggtgggaaaaaacctggcggcagcgcaaaagatg

SEQ ID NO: 241148 - DNA, 103 bp, Artificial Sequence
  Synthetic Polynucleotide
taatacgactcactatagggagctgggacttcccaaagaaggttttcccaaacagaggagatgggaaatgcttctttggaacctggcggcagcgcaaaagatg

SEQ ID NO: 241149 - DNA, 103 bp, Artificial Sequence
  Synthetic Polynucleotide
taatacgactcactatagggatgcgttaggagctgggacttcccaaagaaaacagaggagattctttatgaagtcccagaacctggcggcagcgcaaaagatg

SEQ ID NO: 241150 - DNA, 103 bp, Artificial Sequence
  Synthetic Polynucleotide
taatacgactcactatagggcatcaggtttgagaatttgaaaacccaagaaacagaggagatcttggatgttcaaattcaacctggcggcagcgcaaaagatg

SEQ ID NO: 241151 - DNA, 103 bp, Artificial Sequence
  Synthetic Polynucleotide
taatacgactcactataggggtgttctgtgatgcgttaggagctgggactaacagaggagaagtcccatgtcctaacgcaacctggcggcagcgcaaaagatg

SEQ ID NO: 241152 - DNA, 103 bp, Artificial Sequence
  Synthetic Polynucleotide
taatacgactcactatagggtccccagtgtgtgttctgtgatgcgttaggaacagaggagacctaacatgtcacagaacaacctggcggcagcgcaaaagatg

SEQ ID NO: 241153 - DNA, 103 bp, Artificial Sequence
  Synthetic Polynucleotide
taatacgactcactatagggataaggcttctccccagtgtgtgttctgtgaacagaggagacacagaatgcacactgggaacctggcggcagcgcaaaagatg

SEQ ID NO: 241154 - DNA, 103 bp, Artificial Sequence
  Synthetic Polynucleotide
taatacgactcactatagggcactgcattcataaggcttctccccagtgtaacagaggagaacactgatgagaagccttaacctggcggcagcgcaaaagatg

SEQ ID NO: 241155 - DNA, 103 bp, Artificial Sequence
  Synthetic Polynucleotide
taatacgactcactatagggttcccacactcactgcattcataaggcttcaacagaggagagaagccatgtgaatgcagaacctggcggcagcgcaaaagatg

SEQ ID NO: 241156 - DNA, 103 bp, Artificial Sequence
  Synthetic Polynucleotide
taatacgactcactatagggggtgaaggccttcccacactcactgcattcaacagaggagagaatgcatggagtgtgggaacctggcggcagcgcaaaagatg

SEQ ID NO: 241157 - DNA, 103 bp, Artificial Sequence
  Synthetic Polynucleotide
taatacgactcactatagggttgacttctgggtgaaggccttcccacactaacagaggagaagtgtgatgaggccttcaaacctggcggcagcgcaaaagatg

SEQ ID NO: 241158 - DNA, 103 bp, Artificial Sequence
  Synthetic Polynucleotide
taatacgactcactataggggatatcaggcttgacttctgggtgaaggccaacagaggagaggccttatgccagaagtcaacctggcggcagcgcaaaagatg

SEQ ID NO: 241159 - DNA, 103 bp, Artificial Sequence
  Synthetic Polynucleotide
taatacgactcactatagggtctctgatgtgatatcaggcttgacttctgaacagaggagacagaagatgagcctgataaacctggcggcagcgcaaaagatg

SEQ ID NO: 241160 - DNA, 103 bp, Artificial Sequence
  Synthetic Polynucleotide
taatacgactcactatagggctgtatgtgttctctgatgtgatatcaggcaacagaggagagcctgaatgcacatcagaaacctggcggcagcgcaaaagatg

SEQ ID NO: 241161 - DNA, 103 bp, Artificial Sequence
  Synthetic Polynucleotide
taatacgactcactatagggttgaacattgcatcaggtttgagaatttgaaacagaggagatcaaatatgcaaacctgaaacctggcggcagcgcaaaagatg

SEQ ID NO: 241162 - DNA, 103 bp, Artificial Sequence
  Synthetic Polynucleotide
taatacgactcactatagggggtttctcacctgtatgtgttctctgatgtaacagaggagaacatcaatgaacacatacaacctggcggcagcgcaaaagatg

SEQ ID NO: 241163 - DNA, 103 bp, Artificial Sequence
  Synthetic Polynucleotide
taatacgactcactataggggcattcatagggtttctcacctgtatgtgtaacagaggagaacacatatgggtgagaaaaacctggcggcagcgcaaaagatg

SEQ ID NO: 241164 - DNA, 103 bp, Artificial Sequence
  Synthetic Polynucleotide
taatacgactcactatagggtgcattcactgcattcatagggtttctcacaacagaggagagtgagaatgcctatgaataacctggcggcagcgcaaaagatg

SEQ ID NO: 241165 - DNA, 103 bp, Artificial Sequence
  Synthetic Polynucleotide
taatacgactcactatagggaaggttttcctgcattcactgcattcatagaacagaggagactatgaatgcagtgaatgaacctggcggcagcgcaaaagatg

SEQ ID NO: 241166 - DNA, 103 bp, Artificial Sequence
  Synthetic Polynucleotide
taatacgactcactatagggcttctcactgaaggttttcctgcattcactaacagaggagaagtgaaatgaggaaaaccaacctggcggcagcgcaaaagatg

SEQ ID NO: 241167 - DNA, 103 bp, Artificial Sequence
  Synthetic Polynucleotide
taatacgactcactatagggtgagacttgacttctcactgaaggttttccaacagaggagaggaaaaatgtcagtgagaaacctggcggcagcgcaaaagatg

SEQ ID NO: 241168 - DNA, 103 bp, Artificial Sequence
  Synthetic Polynucleotide
taatacgactcactatagggtgatgatgaatgagacttgacttctcactgaacagaggagacagtgaatggtcaagtctaacctggcggcagcgcaaaagatg

SEQ ID NO: 241169 - DNA, 103 bp, Artificial Sequence
  Synthetic Polynucleotide
taatacgactcactatagggatgggttctctgatgatgaatgagacttgaaacagaggagatcaagtatgattcatcataacctggcggcagcgcaaaagatg

SEQ ID NO: 241170 - DNA, 103 bp, Artificial Sequence
  Synthetic Polynucleotide
taatacgactcactatagggtttctccagtatgggttctctgatgatgaaaacagaggagattcatcatgagagaacccaacctggcggcagcgcaaaagatg

SEQ ID NO: 241171 - DNA, 103 bp, Artificial Sequence
  Synthetic Polynucleotide
taatacgactcactatagggtcaaagggcttttctccagtatgggttctcaacagaggagagagaacatgtactggagaaacctggcggcagcgcaaaagatg

SEQ ID NO: 241172 - DNA, 103 bp, Artificial Sequence
  Synthetic Polynucleotide
taatacgactcactatagggttgttccagtttgaacattgcatcaggtttaacagaggagaaaacctatggcaatgttcaacctggcggcagcgcaaaagatg

SEQ ID NO: 241173 - DNA, 103 bp, Artificial Sequence
  Synthetic Polynucleotide
taatacgactcactatagggttcactacattcaaagggcttttctccagtaacagaggagaactggaatgaagccctttaacctggcggcagcgcaaaagatg

SEQ ID NO: 241174 - DNA, 103 bp, Artificial Sequence
  Synthetic Polynucleotide
taatacgactcactatagggctttcctacattcactacattcaaagggctaacagaggagaagccctatgaatgtagtgaacctggcggcagcgcaaaagatg

SEQ ID NO: 241175 - DNA, 103 bp, Artificial Sequence
  Synthetic Polynucleotide
taatacgactcactatagggcaggcaaaagctttcctacattcactacataacagaggagaatgtagatgatgtaggaaaacctggcggcagcgcaaaagatg

SEQ ID NO: 241176 - DNA, 103 bp, Artificial Sequence
  Synthetic Polynucleotide
taatacgactcactatagggctgtggcttccaggcaaaagctttcctacaaacagaggagatgtaggatggcttttgccaacctggcggcagcgcaaaagatg

SEQ ID NO: 241177 - DNA, 103 bp, Artificial Sequence
  Synthetic Polynucleotide
taatacgactcactataggggcctaagaagctgtggcttccaggcaaaagaacagaggagacttttgatgggaagccacaacctggcggcagcgcaaaagatg

SEQ ID NO: 241178 - DNA, 103 bp, Artificial Sequence
  Synthetic Polynucleotide
taatacgactcactatagggattctctgatgcctaagaagctgtggcttcaacagaggagagaagccatggcttcttagaacctggcggcagcgcaaaagatg

SEQ ID NO: 241179 - DNA, 103 bp, Artificial Sequence
  Synthetic Polynucleotide
taatacgactcactatagggccctgtatgaattctctgatgcctaagaagaacagaggagacttcttatgcatcagagaaacctggcggcagcgcaaaagatg

SEQ ID NO: 241180 - DNA, 103 bp, Artificial Sequence
  Synthetic Polynucleotide
taatacgactcactatagggagggtttctcccctgtatgaattctctgataacagaggagaatcagaatgttcatacagaacctggcggcagcgcaaaagatg

SEQ ID NO: 241181 - DNA, 103 bp, Artificial Sequence
  Synthetic Polynucleotide
taatacgactcactatagggctgcattcatagggtttctcccctgtatgaaacagaggagatcatacatgggagaaaccaacctggcggcagcgcaaaagatg

SEQ ID NO: 241182 - DNA, 103 bp, Artificial Sequence
  Synthetic Polynucleotide
taatacgactcactatagggcccacattcactgcattcatagggtttctcaacagaggagagagaaaatgtatgaatgcaacctggcggcagcgcaaaagatg

SEQ ID NO: 241183 - DNA, 103 bp, Artificial Sequence
  Synthetic Polynucleotide
taatacgactcactatagggatggatcttgttgttccagtttgaacattgaacagaggagacaatgtatgaactggaacaacctggcggcagcgcaaaagatg

SEQ ID NO: 241184 - DNA, 103 bp, Artificial Sequence
  Synthetic Polynucleotide
taatacgactcactatagggcaaatgctttcccacattcactgcattcataacagaggagaatgaatatggtgaatgtgaacctggcggcagcgcaaaagatg

SEQ ID NO: 241185 - DNA, 103 bp, Artificial Sequence
  Synthetic Polynucleotide
taatacgactcactatagggactttctgaacaaatgctttcccacattcaaacagaggagatgaatgatggaaagcattaacctggcggcagcgcaaaagatg

SEQ ID NO: 241186 - DNA, 103 bp, Artificial Sequence
  Synthetic Polynucleotide
taatacgactcactatagggaatgagctgcactttctgaacaaatgctttaacagaggagaaaagcaatggttcagaaaaacctggcggcagcgcaaaagatg

SEQ ID NO: 241187 - DNA, 103 bp, Artificial Sequence
  Synthetic Polynucleotide
taatacgactcactatagggtttgatgcttaatgagctgcactttctgaaaacagaggagattcagaatgtgcagctcaaacctggcggcagcgcaaaagatg

SEQ ID NO: 241188 - DNA, 103 bp, Artificial Sequence
  Synthetic Polynucleotide
taatacgactcactataggggtgtgatttctttgatgcttaatgagctgcaacagaggagagcagctatgtaagcatcaaacctggcggcagcgcaaaagatg

SEQ ID NO: 241189 - DNA, 103 bp, Artificial Sequence
  Synthetic Polynucleotide
taatacgactcactatagggtttctctcctgtgtgatttctttgatgcttaacagaggagaaagcatatgagaaatcacaacctggcggcagcgcaaaagatg

SEQ ID NO: 241190 - DNA, 103 bp, Artificial Sequence
  Synthetic Polynucleotide
taatacgactcactatagggatccataggttttctctcctgtgtgatttcaacagaggagagaaatcatgcaggagagaaacctggcggcagcgcaaaagatg

SEQ ID NO: 241191 - DNA, 103 bp, Artificial Sequence
  Synthetic Polynucleotide
taatacgactcactatagggcaatcgctgcatccataggttttctctcctaacagaggagaaggagaatgaacctatggaacctggcggcagcgcaaaagatg

SEQ ID NO: 241192 - DNA, 103 bp, Artificial Sequence
  Synthetic Polynucleotide
taatacgactcactatagggagcttttgcacaatcgctgcatccataggtaacagaggagaacctatatgtgcagcgataacctggcggcagcgcaaaagatg

SEQ ID NO: 241193 - DNA, 103 bp, Artificial Sequence
  Synthetic Polynucleotide
taatacgactcactatagggtctcaaagaaagcttttgcacaatcgctgcaacagaggagagcagcgatggtgcaaaagaacctggcggcagcgcaaaagatg

SEQ ID NO: 241194 - DNA, 103 bp, Artificial Sequence
  Synthetic Polynucleotide
taatacgactcactatagggcctattatccatggatcttgttgttccagtaacagaggagaactggaatgacaagatccaacctggcggcagcgcaaaagatg

SEQ ID NO: 241195 - DNA, 103 bp, Artificial Sequence
  Synthetic Polynucleotide
taatacgactcactatagggagctgtgccttctcaaagaaagcttttgcaaacagaggagatgcaaaatgtttctttgaaacctggcggcagcgcaaaagatg

SEQ ID NO: 241196 - DNA, 103 bp, Artificial Sequence
  Synthetic Polynucleotide
taatacgactcactatagggatgtataatcagctgtgccttctcaaagaaaacagaggagattctttatgaaggcacagaacctggcggcagcgcaaaagatg

SEQ ID NO: 241197 - DNA, 103 bp, Artificial Sequence
  Synthetic Polynucleotide
taatacgactcactataggggaattctctgatgtataatcagctgtgcctaacagaggagaaggcacatgtgattatacaacctggcggcagcgcaaaagatg

SEQ ID NO: 241198 - DNA, 103 bp, Artificial Sequence
  Synthetic Polynucleotide
taatacgactcactatagggtctcctgtatgaattctctgatgtataatcaacagaggagagattatatgtcagagaataacctggcggcagcgcaaaagatg

SEQ ID NO: 241199 - DNA, 103 bp, Artificial Sequence
  Synthetic Polynucleotide
taatacgactcactatagggatatggtctctctcctgtatgaattctctgaacagaggagacagagaatgcatacaggaaacctggcggcagcgcaaaagatg

SEQ ID NO: 241200 - DNA, 103 bp, Artificial Sequence
  Synthetic Polynucleotide
taatacgactcactatagggcaccacatttatatggtctctctcctgtataacagaggagaatacagatgagagaccataacctggcggcagcgcaaaagatg

SEQ ID NO: 241201 - DNA, 103 bp, Artificial Sequence
  Synthetic Polynucleotide
taatacgactcactatagggttcccacattcaccacatttatatggtctcaacagaggagagagaccatgtaaatgtggaacctggcggcagcgcaaaagatg

SEQ ID NO: 241202 - DNA, 103 bp, Artificial Sequence
  Synthetic Polynucleotide
taatacgactcactatagggtgtgaaagatttcccacattcaccacatttaacagaggagaaaatgtatggaatgtgggaacctggcggcagcgcaaaagatg

SEQ ID NO: 241203 - DNA, 103 bp, Artificial Sequence
  Synthetic Polynucleotide
taatacgactcactataggggtgactttcttgtgaaagatttcccacattaacagaggagaaatgtgatgaatctttcaaacctggcggcagcgcaaaagatg

SEQ ID NO: 241204 - DNA, 103 bp, Artificial Sequence
  Synthetic Polynucleotide
taatacgactcactatagggctcataaggtgtgactttcttgtgaaagataacagaggagaatctttatgaagaaagtcaacctggcggcagcgcaaaagatg

SEQ ID NO: 241205 - DNA, 103 bp, Artificial Sequence
  Synthetic Polynucleotide
taatacgactcactataggggatttcttgacctattatccatggatcttgaacagaggagacaagatatgtggataataaacctggcggcagcgcaaaagatg

SEQ ID NO: 241206 - DNA, 103 bp, Artificial Sequence
  Synthetic Polynucleotide
taatacgactcactatagggcctctgatgcctcataaggtgtgactttctaacagaggagaagaaagatgcaccttatgaacctggcggcagcgcaaaagatg

SEQ ID NO: 241207 - DNA, 103 bp, Artificial Sequence
  Synthetic Polynucleotide
taatacgactcactatagggctgtatgaatcctctgatgcctcataaggtaacagaggagaaccttaatgggcatcagaaacctggcggcagcgcaaaagatg

SEQ ID NO: 241208 - DNA, 103 bp, Artificial Sequence
  Synthetic Polynucleotide
taatacgactcactatagggtatttatctcctgtatgaatcctctgatgcaacagaggagagcatcaatggattcatacaacctggcggcagcgcaaaagatg

SEQ ID NO: 241209 - DNA, 103 bp, Artificial Sequence
  Synthetic Polynucleotide
taatacgactcactataggggcatccatagtatttatctcctgtatgaataacagaggagaattcatatgggagataaaaacctggcggcagcgcaaaagatg

SEQ ID NO: 241210 - DNA, 103 bp, Artificial Sequence
  Synthetic Polynucleotide
taatacgactcactatagggcacactcattgcatccatagtatttatctcaacagaggagagagataatgactatggataacctggcggcagcgcaaaagatg

SEQ ID NO: 241211 - DNA, 103 bp, Artificial Sequence
  Synthetic Polynucleotide
taatacgactcactatagggaaggtggtcccacactcattgcatccatagaacagaggagactatggatgcaatgagtgaacctggcggcagcgcaaaagatg

SEQ ID NO: 241212 - DNA, 103 bp, Artificial Sequence
  Synthetic Polynucleotide
taatacgactcactatagggcttcctgttgaaggtggtcccacactcattaacagaggagaaatgagatggggaccaccaacctggcggcagcgcaaaagatg

SEQ ID NO: 241213 - DNA, 103 bp, Artificial Sequence
  Synthetic Polynucleotide
taatacgactcactatagggtaagctgcgacttcctgttgaaggtggtccaacagaggagaggaccaatgtcaacaggaaacctggcggcagcgcaaaagatg

SEQ ID NO: 241214 - DNA, 103 bp, Artificial Sequence
  Synthetic Polynucleotide
taatacgactcactatagggtgatgtatcataagctgcgacttcctgttgaacagaggagacaacagatggtcgcagctaacctggcggcagcgcaaaagatg

SEQ ID NO: 241215 - DNA, 103 bp, Artificial Sequence
  Synthetic Polynucleotide
taatacgactcactatagggatgatttctctgatgtatcataagctgcgaaacagaggagatcgcagatgatgatacataacctggcggcagcgcaaaagatg

SEQ ID NO: 241216 - DNA, 103 bp, Artificial Sequence
  Synthetic Polynucleotide
taatacgactcactatagggccacagccacatcctcaaatgatatctgtgaacagaggagacacagaatgcatttgaggaacctggcggcagcgcaaaagatg

SEQ ID NO: 241217 - DNA, 103 bp, Artificial Sequence
  Synthetic Polynucleotide
taatacgactcactatagggtctgatttaggatttcttgacctattatccaacagaggagaggataaatggtcaagaaaaacctggcggcagcgcaaaagatg

SEQ ID NO: 241218 - DNA, 103 bp, Artificial Sequence
  Synthetic Polynucleotide
taatacgactcactatagggtctgaaaagttctgatttaggatttcttgaaacagaggagatcaagaatgcctaaatcaaacctggcggcagcgcaaaagatg

SEQ ID NO: 241219 - DNA, 103 bp, Artificial Sequence
  Synthetic Polynucleotide
taatacgactcactatagggtagccagacttctgaaaagttctgatttagaacagaggagactaaatatgaacttttcaaacctggcggcagcgcaaaagatg

SEQ ID NO: 241220 - DNA, 103 bp, Artificial Sequence
  Synthetic Polynucleotide
taatacgactcactatagggtgggattatctagccagacttctgaaaagtaacagaggagaacttttatgaagtctggcaacctggcggcagcgcaaaagatg

SEQ ID NO: 241221 - DNA, 103 bp, Artificial Sequence
  Synthetic Polynucleotide
taatacgactcactatagggagccacattttgggattatctagccagactaacagaggagaagtctgatgagataatccaacctggcggcagcgcaaaagatg

SEQ ID NO: 241222 - DNA, 103 bp, Artificial Sequence
  Synthetic Polynucleotide
taatacgactcactatagggattatctcggagccacattttgggattatcaacagaggagagataatatgaaaatgtggaacctggcggcagcgcaaaagatg

SEQ ID NO: 241223 - DNA, 103 bp, Artificial Sequence
  Synthetic Polynucleotide
taatacgactcactatagggggttgtcttgattatctcggagccacatttaacagaggagaaaatgtatgtccgagataaacctggcggcagcgcaaaagatg

SEQ ID NO: 241224 - DNA, 103 bp, Artificial Sequence
  Synthetic Polynucleotide
taatacgactcactatagggatacttttaaggttgtcttgattatctcggaacagaggagaccgagaatgtcaagacaaaacctggcggcagcgcaaaagatg

SEQ ID NO: 241225 - DNA, 103 bp, Artificial Sequence
  Synthetic Polynucleotide
taatacgactcactataggggcctctctccatacttttaaggttgtcttgaacagaggagacaagacatgcttaaaagtaacctggcggcagcgcaaaagatg

SEQ ID NO: 241226 - DNA, 103 bp, Artificial Sequence
  Synthetic Polynucleotide
taatacgactcactatagggcatatttatggcctctctccatacttttaaaacagaggagattaaaaatgtggagagagaacctggcggcagcgcaaaagatg

SEQ ID NO: 241227 - DNA, 103 bp, Artificial Sequence
  Synthetic Polynucleotide
taatacgactcactatagggagcgtgaaatccacagccacatcctcaaataacagaggagaatttgaatgtgtggctgtaacctggcggcagcgcaaaagatg

SEQ ID NO: 241228 - DNA, 103 bp, Artificial Sequence
  Synthetic Polynucleotide
taatacgactcactatagggccaaaaacatcatatttatggcctctctccaacagaggagaggagagatgccataaataaacctggcggcagcgcaaaagatg

SEQ ID NO: 241229 - DNA, 103 bp, Artificial Sequence
  Synthetic Polynucleotide
taatacgactcactatagggaaatatttttccaaaaacatcatatttatgaacagaggagacataaaatggatgtttttaacctggcggcagcgcaaaagatg

SEQ ID NO: 241230 - DNA, 103 bp, Artificial Sequence
  Synthetic Polynucleotide
taatacgactcactatagggtgcttgaattaaatatttttccaaaaacataacagaggagaatgtttatggaaaaatataacctggcggcagcgcaaaagatg

SEQ ID NO: 241231 - DNA, 103 bp, Artificial Sequence
  Synthetic Polynucleotide
taatacgactcactatagggacaatgtttatgcttgaattaaatatttttaacagaggagaaaaaatatgtaattcaagaacctggcggcagcgcaaaagatg

SEQ ID NO: 241232 - DNA, 103 bp, Artificial Sequence
  Synthetic Polynucleotide
taatacgactcactatagggtcctacatgaacaatgtttatgcttgaattaacagaggagaaattcaatgataaacattaacctggcggcagcgcaaaagatg

SEQ ID NO: 241233 - DNA, 103 bp, Artificial Sequence
  Synthetic Polynucleotide
taatacgactcactataggggggatcgcagtcctacatgaacaatgtttaaacagaggagataaacaatgttcatgtagaacctggcggcagcgcaaaagatg

SEQ ID NO: 241234 - DNA, 103 bp, Artificial Sequence
  Synthetic Polynucleotide
taatacgactcactatagggccacatttatgggatcgcagtcctacatgaaacagaggagatcatgtatgactgcgatcaacctggcggcagcgcaaaagatg

SEQ ID NO: 241235 - DNA, 103 bp, Artificial Sequence
  Synthetic Polynucleotide
taatacgactcactatagggttctcctgtgccacatttatgggatcgcagaacagaggagactgcgaatgcataaatgtaacctggcggcagcgcaaaagatg

SEQ ID NO: 241236 - DNA, 103 bp, Artificial Sequence
  Synthetic Polynucleotide
taatacgactcactatagggtcaaacttttttctcctgtgccacatttataacagaggagaataaatatggcacaggagaacctggcggcagcgcaaaagatg

SEQ ID NO: 241237 - DNA, 103 bp, Artificial Sequence
  Synthetic Polynucleotide
taatacgactcactatagggaaaggacatttcaaacttttttctcctgtgaacagaggagacacaggatgaaaaagtttaacctggcggcagcgcaaaagatg

SEQ ID NO: 241238 - DNA, 103 bp, Artificial Sequence
  Synthetic Polynucleotide
taatacgactcactatagggccattcctccagcgtgaaatccacagccacaacagaggagagtggctatggatttcacgaacctggcggcagcgcaaaagatg

SEQ ID NO: 241239 - DNA, 103 bp, Artificial Sequence
  Synthetic Polynucleotide
taatacgactcactatagggaagcaaatcaaaaggacatttcaaacttttaacagaggagaaaaagtatgaaatgtcctaacctggcggcagcgcaaaagatg

SEQ ID NO: 241240 - DNA, 103 bp, Artificial Sequence
  Synthetic Polynucleotide
taatacgactcactatagggtttttggaataagcaaatcaaaaggacattaacagaggagaaatgtcatgttgatttgcaacctggcggcagcgcaaaagatg

SEQ ID NO: 241241 - DNA, 103 bp, Artificial Sequence
  Synthetic Polynucleotide
taatacgactcactatagggtcacaattattttttggaataagcaaatcaaacagaggagatgatttatgtattccaaaaacctggcggcagcgcaaaagatg

SEQ ID NO: 241242 - DNA, 103 bp, Artificial Sequence
  Synthetic Polynucleotide
taatacgactcactatagggtttctttctttcacaattattttttggaataacagaggagaattccaatgaataattgtaacctggcggcagcgcaaaagatg

SEQ ID NO: 241243 - DNA, 103 bp, Artificial Sequence
  Synthetic Polynucleotide
taatacgactcactataggggttcatcaattttctttctttcacaattataacagaggagaataattatgaaagaaagaaacctggcggcagcgcaaaagatg

SEQ ID NO: 241244 - DNA, 103 bp, Artificial Sequence
  Synthetic Polynucleotide
taatacgactcactatagggttcttattgagttcatcaattttctttcttaacagaggagaaagaaaatgaattgatgaaacctggcggcagcgcaaaagatg

SEQ ID NO: 241245 - DNA, 103 bp, Artificial Sequence
  Synthetic Polynucleotide
taatacgactcactataggggaacaataatttcttattgagttcatcaataacagaggagaattgatatgctcaataagaacctggcggcagcgcaaaagatg

SEQ ID NO: 241246 - DNA, 103 bp, Artificial Sequence
  Synthetic Polynucleotide
taatacgactcactataggggtttgatacagaacaataatttcttattgaaacagaggagatcaataatgaattattgtaacctggcggcagcgcaaaagatg

SEQ ID NO: 241247 - DNA, 103 bp, Artificial Sequence
  Synthetic Polynucleotide
taatacgactcactataggggttctgccaggtttgatacagaacaataataacagaggagaattattatgctgtatcaaaacctggcggcagcgcaaaagatg

SEQ ID NO: 241248 - DNA, 103 bp, Artificial Sequence
  Synthetic Polynucleotide
taatacgactcactatagggcccaccatgggttctgccaggtttgatacaaacagaggagatgtatcatgcctggcagaaacctggcggcagcgcaaaagatg

SEQ ID NO: 241249 - DNA, 103 bp, Artificial Sequence
  Synthetic Polynucleotide
taatacgactcactatagggtaagtagctgccattcctccagcgtgaaataacagaggagaatttcaatgtggaggaataacctggcggcagcgcaaaagatg

SEQ ID NO: 241250 - DNA, 103 bp, Artificial Sequence
  Synthetic Polynucleotide
taatacgactcactatagggagtattttatcccaccatgggttctgccagaacagaggagactggcaatgcccatggtgaacctggcggcagcgcaaaagatg

SEQ ID NO: 241251 - DNA, 103 bp, Artificial Sequence
  Synthetic Polynucleotide
taatacgactcactatagggctgcaatcacagtattttatcccaccatggaacagaggagaccatggatggataaaataaacctggcggcagcgcaaaagatg

SEQ ID NO: 241252 - DNA, 103 bp, Artificial Sequence
  Synthetic Polynucleotide
taatacgactcactatagggtctacatgtactgcaatcacagtattttataacagaggagaataaaaatgtgtgattgcaacctggcggcagcgcaaaagatg

SEQ ID NO: 241253 - DNA, 103 bp, Artificial Sequence
  Synthetic Polynucleotide
taatacgactcactatagggtgctggattttctacatgtactgcaatcacaacagaggagagtgattatggtacatgtaaacctggcggcagcgcaaaagatg

SEQ ID NO: 241254 - DNA, 103 bp, Artificial Sequence
  Synthetic Polynucleotide
taatacgactcactatagggggctcttcgttgctggattttctacatgtaaacagaggagatacatgatgaaaatccagaacctggcggcagcgcaaaagatg

SEQ ID NO: 241255 - DNA, 103 bp, Artificial Sequence
  Synthetic Polynucleotide
taatacgactcactatagggagtgagccatggctcttcgttgctggatttaacagaggagaaaatccatgaacgaagagaacctggcggcagcgcaaaagatg

SEQ ID NO: 241256 - DNA, 103 bp, Artificial Sequence
  Synthetic Polynucleotide
taatacgactcactatagggtgtgattagcagtgagccatggctcttcgtaacagaggagaacgaagatgcatggctcaaacctggcggcagcgcaaaagatg

SEQ ID NO: 241257 - DNA, 103 bp, Artificial Sequence
  Synthetic Polynucleotide
taatacgactcactataggggtgtgtgttatgtgattagcagtgagccataacagaggagaatggctatgtgctaatcaaacctggcggcagcgcaaaagatg

SEQ ID NO: 241258 - DNA, 103 bp, Artificial Sequence
  Synthetic Polynucleotide
taatacgactcactatagggatagactcctgtgtgtgttatgtgattagcaacagaggagagctaatatgataacacacaacctggcggcagcgcaaaagatg

SEQ ID NO: 241259 - DNA, 103 bp, Artificial Sequence
  Synthetic Polynucleotide
taatacgactcactatagggccatgcataaatagactcctgtgtgtgttaaacagaggagataacacatgcaggagtctaacctggcggcagcgcaaaagatg

SEQ ID NO: 241260 - DNA, 103 bp, Artificial Sequence
  Synthetic Polynucleotide
taatacgactcactatagggtgagtaggattaagtagctgccattcctccaacagaggagaggaggaatggcagctactaacctggcggcagcgcaaaagatg

SEQ ID NO: 241261 - DNA, 103 bp, Artificial Sequence
  Synthetic Polynucleotide
taatacgactcactatagggctgccacattccatgcataaatagactcctaacagaggagaaggagtatgtttatgcataacctggcggcagcgcaaaagatg

SEQ ID NO: 241262 - DNA, 103 bp, Artificial Sequence
  Synthetic Polynucleotide
taatacgactcactataggggttaaaaaatctgccacattccatgcataaaacagaggagattatgcatggaatgtggcaacctggcggcagcgcaaaagatg

SEQ ID NO: 241263 - DNA, 103 bp, Artificial Sequence
  Synthetic Polynucleotide
taatacgactcactataggggtgacttcttgttaaaaaatctgccacattaacagaggagaaatgtgatggattttttaaacctggcggcagcgcaaaagatg

SEQ ID NO: 241264 - DNA, 103 bp, Artificial Sequence
  Synthetic Polynucleotide
taatacgactcactatagggataacaagttgtgacttcttgttaaaaaataacagaggagaatttttatgcaagaagtcaacctggcggcagcgcaaaagatg

SEQ ID NO: 241265 - DNA, 103 bp, Artificial Sequence
  Synthetic Polynucleotide
taatacgactcactatagggtctctggtgtataacaagttgtgacttcttaacagaggagaaagaagatgcaacttgttaacctggcggcagcgcaaaagatg

SEQ ID NO: 241266 - DNA, 103 bp, Artificial Sequence
  Synthetic Polynucleotide
taatacgactcactatagggctgtatgagttctctggtgtataacaagttaacagaggagaaacttgatgtacaccagaaacctggcggcagcgcaaaagatg

SEQ ID NO: 241267 - DNA, 103 bp, Artificial Sequence
  Synthetic Polynucleotide
taatacgactcactatagggggcttctctcctgtatgagttctctggtgtaacagaggagaacaccaatgaactcatacaacctggcggcagcgcaaaagatg

SEQ ID NO: 241268 - DNA, 103 bp, Artificial Sequence
  Synthetic Polynucleotide
taatacgactcactataggggcattgatagggcttctctcctgtatgagtaacagaggagaactcatatgggagagaagaacctggcggcagcgcaaaagatg

SEQ ID NO: 241269 - DNA, 103 bp, Artificial Sequence
  Synthetic Polynucleotide
taatacgactcactatagggcacactcactgcattgatagggcttctctcaacagaggagagagagaatgcctatcaataacctggcggcagcgcaaaagatg

SEQ ID NO: 241270 - DNA, 103 bp, Artificial Sequence
  Synthetic Polynucleotide
taatacgactcactatagggaaggcttttccacactcactgcattgatagaacagaggagactatcaatgcagtgagtgaacctggcggcagcgcaaaagatg

SEQ ID NO: 241271 - DNA, 103 bp, Artificial Sequence
  Synthetic Polynucleotide
taatacgactcactatagggcaagttcttctgagtaggattaagtagctgaacagaggagacagctaatgaatcctactaacctggcggcagcgcaaaagatg

SEQ ID NO: 241272 - DNA, 103 bp, Artificial Sequence
  Synthetic Polynucleotide
taatacgactcactatagggcttctgtgaaaaggcttttccacactcactaacagaggagaagtgagatgggaaaagccaacctggcggcagcgcaaaagatg

SEQ ID NO: 241273 - DNA, 103 bp, Artificial Sequence
  Synthetic Polynucleotide
taatacgactcactatagggtgagcagtgacttctgtgaaaaggcttttcaacagaggagagaaaagatgtttcacagaaacctggcggcagcgcaaaagatg

SEQ ID NO: 241274 - DNA, 103 bp, Artificial Sequence
  Synthetic Polynucleotide
taatacgactcactatagggtgatgaaccgtgagcagtgacttctgtgaaaacagaggagattcacaatggtcactgctaacctggcggcagcgcaaaagatg

SEQ ID NO: 241275 - DNA, 103 bp, Artificial Sequence
  Synthetic Polynucleotide
taatacgactcactataggggtgagttctttgatgaaccgtgagcagtgaaacagaggagatcactgatgacggttcataacctggcggcagcgcaaaagatg

SEQ ID NO: 241276 - DNA, 103 bp, Artificial Sequence
  Synthetic Polynucleotide
taatacgactcactatagggtttctcctgagtgagttctttgatgaaccgaacagaggagacggttcatgaaagaactcaacctggcggcagcgcaaaagatg

SEQ ID NO: 241277 - DNA, 103 bp, Artificial Sequence
  Synthetic Polynucleotide
taatacgactcactatagggccatgcggtttttctcctgagtgagttcttaacagaggagaaagaacatgctcaggagaaacctggcggcagcgcaaaagatg

SEQ ID NO: 241278 - DNA, 103 bp, Artificial Sequence
  Synthetic Polynucleotide
taatacgactcactatagggttcgctgcacccatgcggtttttctcctgaaacagaggagatcaggaatgaaaccgcataacctggcggcagcgcaaaagatg

SEQ ID NO: 241279 - DNA, 103 bp, Artificial Sequence
  Synthetic Polynucleotide
taatacgactcactatagggctttctgacattcgctgcacccatgcggttaacagaggagaaaccgcatgggtgcagcgaacctggcggcagcgcaaaagatg

SEQ ID NO: 241280 - DNA, 103 bp, Artificial Sequence
  Synthetic Polynucleotide
taatacgactcactatagggctactaaaagctttctgacattcgctgcacaacagaggagagtgcagatgatgtcagaaaacctggcggcagcgcaaaagatg

SEQ ID NO: 241281 - DNA, 103 bp, Artificial Sequence
  Synthetic Polynucleotide
taatacgactcactataggggagtgacttcctactaaaagctttctgacaaacagaggagatgtcagatggcttttagtaacctggcggcagcgcaaaagatg

SEQ ID NO: 241282 - DNA, 103 bp, Artificial Sequence
  Synthetic Polynucleotide
taatacgactcactatagggcatctctgtacaagttcttctgagtaggataacagaggagaatcctaatgagaagaactaacctggcggcagcgcaaaagatg

SEQ ID NO: 241283 - DNA, 103 bp, Artificial Sequence
  Synthetic Polynucleotide
taatacgactcactataggggtaaaatgaggagtgacttcctactaaaagaacagaggagacttttaatgggaagtcacaacctggcggcagcgcaaaagatg

SEQ ID NO: 241284 - DNA, 103 bp, Artificial Sequence
  Synthetic Polynucleotide
taatacgactcactatagggattctctgatgtaaaatgaggagtgacttcaacagaggagagaagtcatgcctcattttaacctggcggcagcgcaaaagatg

SEQ ID NO: 241285 - DNA, 103 bp, Artificial Sequence
  Synthetic Polynucleotide
taatacgactcactatagggtccagtatgaattctctgatgtaaaatgagaacagaggagactcattatgcatcagagaaacctggcggcagcgcaaaagatg

SEQ ID NO: 241286 - DNA, 103 bp, Artificial Sequence
  Synthetic Polynucleotide
taatacgactcactatagggacggcttctctccagtatgaattctctgataacagaggagaatcagaatgttcatactgaacctggcggcagcgcaaaagatg

SEQ ID NO: 241287 - DNA, 103 bp, Artificial Sequence
  Synthetic Polynucleotide
taatacgactcactatagggctgcatccatacggcttctctccagtatgaaacagaggagatcatacatgagagaagccaacctggcggcagcgcaaaagatg

SEQ ID NO: 241288 - DNA, 103 bp, Artificial Sequence
  Synthetic Polynucleotide
taatacgactcactatagggtccacattcactgcatccatacggcttctcaacagaggagagagaagatgtatggatgcaacctggcggcagcgcaaaagatg

SEQ ID NO: 241289 - DNA, 103 bp, Artificial Sequence
  Synthetic Polynucleotide
taatacgactcactatagggtgaaggcttttccacattcactgcatccataacagaggagaatggatatggtgaatgtgaacctggcggcagcgcaaaagatg

SEQ ID NO: 241290 - DNA, 103 bp, Artificial Sequence
  Synthetic Polynucleotide
taatacgactcactataggggacttcctactgaaggcttttccacattcaaacagaggagatgaatgatgaaaagccttaacctggcggcagcgcaaaagatg

SEQ ID NO: 241291 - DNA, 103 bp, Artificial Sequence
  Synthetic Polynucleotide
taatacgactcactatagggtttaagctgcgacttcctactgaaggctttaacagaggagaaaagccatgagtaggaagaacctggcggcagcgcaaaagatg

SEQ ID NO: 241292 - DNA, 103 bp, Artificial Sequence
  Synthetic Polynucleotide
taatacgactcactatagggtctgatgtcttttaagctgcgacttcctacaacagaggagagtaggaatgcgcagcttaaacctggcggcagcgcaaaagatg

SEQ ID NO: 241293 - DNA, 103 bp, Artificial Sequence
  Synthetic Polynucleotide
taatacgactcactatagggtccaacatcacatctctgtacaagttcttcaacagaggagagaagaaatggtacagagaaacctggcggcagcgcaaaagatg

SEQ ID NO: 241294 - DNA, 103 bp, Artificial Sequence
  Synthetic Polynucleotide
taatacgactcactataggggtgtgcgttatctgatgtcttttaagctgcaacagaggagagcagctatgaagacatcaaacctggcggcagcgcaaaagatg

SEQ ID NO: 241295 - DNA, 103 bp, Artificial Sequence
  Synthetic Polynucleotide
taatacgactcactatagggtttctctattgtgtgcgttatctgatgtctaacagaggagaagacatatgataacgcacaacctggcggcagcgcaaaagatg

SEQ ID NO: 241296 - DNA, 103 bp, Artificial Sequence
  Synthetic Polynucleotide
taatacgactcactatagggaactgtagggtttctctattgtgtgcgttaaacagaggagataacgcatgcaatagagaaacctggcggcagcgcaaaagatg

SEQ ID NO: 241297 - DNA, 103 bp, Artificial Sequence
  Synthetic Polynucleotide
taatacgactcactatagggcactcactgcaactgtagggtttctctattaacagaggagaaatagaatgaccctacagaacctggcggcagcgcaaaagatg

SEQ ID NO: 241298 - DNA, 103 bp, Artificial Sequence
  Synthetic Polynucleotide
taatacgactcactatagggtgctttcccacactcactgcaactgtagggaacagaggagaccctacatgtgcagtgagaacctggcggcagcgcaaaagatg

SEQ ID NO: 241299 - DNA, 103 bp, Artificial Sequence
  Synthetic Polynucleotide
taatacgactcactatagggtctgggagaatgctttcccacactcactgcaacagaggagagcagtgatggtgggaaagaacctggcggcagcgcaaaagatg

SEQ ID NO: 241300 - DNA, 103 bp, Artificial Sequence
  Synthetic Polynucleotide
taatacgactcactatagggagttttaatttctgggagaatgctttcccaaacagaggagatgggaaatgattctcccaaacctggcggcagcgcaaaagatg

SEQ ID NO: 241301 - DNA, 103 bp, Artificial Sequence
  Synthetic Polynucleotide
taatacgactcactatagggatgtgtgatgagttttaatttctgggagaaaacagaggagattctccatgaaattaaaaaacctggcggcagcgcaaaagatg

SEQ ID NO: 241302 - DNA, 103 bp, Artificial Sequence
  Synthetic Polynucleotide
taatacgactcactataggggcgctctctgatgtgtgatgagttttaattaacagaggagaaattaaatgtcatcacacaacctggcggcagcgcaaaagatg

SEQ ID NO: 241303 - DNA, 103 bp, Artificial Sequence
  Synthetic Polynucleotide
taatacgactcactatagggtctcctgtgtgcgctctctgatgtgtgatgaacagaggagacatcacatgtcagagagcaacctggcggcagcgcaaaagatg

SEQ ID NO: 241304 - DNA, 103 bp, Artificial Sequence
  Synthetic Polynucleotide
taatacgactcactatagggcagggtcagtgattcctgggacttgatcataacagaggagaatgatcatgtcccaggaaaacctggcggcagcgcaaaagatg

SEQ ID NO: 241305 - DNA, 103 bp, Artificial Sequence
  Synthetic Polynucleotide
taatacgactcactataggggttctccaacatcacgtctcggtacaggtcaacagaggagagacctgatgcgagacgtgaacctggcggcagcgcaaaagatg

SEQ ID NO: 241306 - DNA, 103 bp, Artificial Sequence
  Synthetic Polynucleotide
taatacgactcactatagggtcctgtatgagttctctggtgttcagtgagaacagaggagactcactatgcaccagagaaacctggcggcagcgcaaaagatg

SEQ ID NO: 241307 - DNA, 103 bp, Artificial Sequence
  Synthetic Polynucleotide
taatacgactcactatagggagggtttctctcctgtatgagttctctggtaacagaggagaaccagaatgctcatacagaacctggcggcagcgcaaaagatg

SEQ ID NO: 241308 - DNA, 103 bp, Artificial Sequence
  Synthetic Polynucleotide
taatacgactcactataggggtgcattcatagggtttctctcctgtatgaaacagaggagatcatacatgagagaaaccaacctggcggcagcgcaaaagatg

SEQ ID NO: 241309 - DNA, 103 bp, Artificial Sequence
  Synthetic Polynucleotide
taatacgactcactataggggtcacattcagtgcattcatagggtttctcaacagaggagagagaaaatgtatgaatgcaacctggcggcagcgcaaaagatg

SEQ ID NO: 241310 - DNA, 103 bp, Artificial Sequence
  Synthetic Polynucleotide
taatacgactcactatagggggaatgctttgtcacattcagtgcattcataacagaggagaatgaatatgctgaatgtgaacctggcggcagcgcaaaagatg

SEQ ID NO: 241311 - DNA, 103 bp, Artificial Sequence
  Synthetic Polynucleotide
taatacgactcactataggggatttccagcggaatgctttgtcacattcaaacagaggagatgaatgatgcaaagcattaacctggcggcagcgcaaaagatg

SEQ ID NO: 241312 - DNA, 103 bp, Artificial Sequence
  Synthetic Polynucleotide
taatacgactcactatagggattgagctgtgatttccagcggaatgctttaacagaggagaaaagcaatgcgctggaaaaacctggcggcagcgcaaaagatg

SEQ ID NO: 241313 - DNA, 103 bp, Artificial Sequence
  Synthetic Polynucleotide
taatacgactcactatagggtctgatgtgcattgagctgtgatttccagcaacagaggagagctggaatgcacagctcaaacctggcggcagcgcaaaagatg

SEQ ID NO: 241314 - DNA, 103 bp, Artificial Sequence
  Synthetic Polynucleotide
taatacgactcactataggggtgtgagctttctgatgtgcattgagctgtaacagaggagaacagctatgtgcacatcaaacctggcggcagcgcaaaagatg

SEQ ID NO: 241315 - DNA, 103 bp, Artificial Sequence
  Synthetic Polynucleotide
taatacgactcactatagggcttctctcctgtgtgagctttctgatgtgcaacagaggagagcacatatgaaagctcacaacctggcggcagcgcaaaagatg

SEQ ID NO: 241316 - DNA, 103 bp, Artificial Sequence
  Synthetic Polynucleotide
taatacgactcactatagggggttgctatagttctccaacatcacgtctcaacagaggagagagacgatgtgttggagaaacctggcggcagcgcaaaagatg

SEQ ID NO: 241317 - DNA, 103 bp, Artificial Sequence
  Synthetic Polynucleotide
taatacgactcactatagggatatatatgacttctctcctgtgtgagcttaacagaggagaaagctcatgcaggagagaaacctggcggcagcgcaaaagatg

SEQ ID NO: 241318 - DNA, 103 bp, Artificial Sequence
  Synthetic Polynucleotide
taatacgactcactatagggcaatcacggcatatatatgacttctctcctaacagaggagaaggagaatggtcatatataacctggcggcagcgcaaaagatg

SEQ ID NO: 241319 - DNA, 103 bp, Artificial Sequence
  Synthetic Polynucleotide
taatacgactcactataggggccttttccacaatcacggcatatatatgaaacagaggagatcatatatgtgccgtgataacctggcggcagcgcaaaagatg

SEQ ID NO: 241320 - DNA, 103 bp, Artificial Sequence
  Synthetic Polynucleotide
taatacgactcactatagggtctgaatgaagccttttccacaatcacggcaacagaggagagccgtgatggtggaaaagaacctggcggcagcgcaaaagatg

SEQ ID NO: 241321 - DNA, 103 bp, Artificial Sequence
  Synthetic Polynucleotide
taatacgactcactatagggagatttcccttctgaatgaagccttttccaaacagaggagatggaaaatgcttcattcaaacctggcggcagcgcaaaagatg

SEQ ID NO: 241322 - DNA, 103 bp, Artificial Sequence
  Synthetic Polynucleotide
taatacgactcactatagggatgtacaatgagatttcccttctgaatgaaaacagaggagattcattatgaagggaaataacctggcggcagcgcaaaagatg

SEQ ID NO: 241323 - DNA, 103 bp, Artificial Sequence
  Synthetic Polynucleotide
taatacgactcactataggggaattcgctgatgtacaatgagatttccctaacagaggagaagggaaatgtcattgtacaacctggcggcagcgcaaaagatg

SEQ ID NO: 241324 - DNA, 103 bp, Artificial Sequence
  Synthetic Polynucleotide
taatacgactcactatagggtctccagtatgaattcgctgatgtacaatgaacagaggagacattgtatgtcagcgaataacctggcggcagcgcaaaagatg

SEQ ID NO: 241325 - DNA, 103 bp, Artificial Sequence
  Synthetic Polynucleotide
taatacgactcactatagggatagggtttttctccagtatgaattcgctgaacagaggagacagcgaatgcatactggaaacctggcggcagcgcaaaagatg

SEQ ID NO: 241326 - DNA, 103 bp, Artificial Sequence
  Synthetic Polynucleotide
taatacgactcactatagggcattgcatatatagggtttttctccagtataacagaggagaatactgatgaaaaaccctaacctggcggcagcgcaaaagatg

SEQ ID NO: 241327 - DNA, 103 bp, Artificial Sequence
  Synthetic Polynucleotide
taatacgactcactatagggactgacacgaggttgctatagttctccaacaacagaggagagttggaatgctatagcaaaacctggcggcagcgcaaaagatg

SEQ ID NO: 241328 - DNA, 103 bp, Artificial Sequence
  Synthetic Polynucleotide
taatacgactcactatagggtttccacattcattgcatatatagggttttaacagaggagaaaaaccatgtatatgcaaaacctggcggcagcgcaaaagatg

SEQ ID NO: 241329 - DNA, 103 bp, Artificial Sequence
  Synthetic Polynucleotide
taatacgactcactataggggatgaagccttttccacattcattgcatataacagaggagaatatgcatggaatgtggaaacctggcggcagcgcaaaagatg

SEQ ID NO: 241330 - DNA, 103 bp, Artificial Sequence
  Synthetic Polynucleotide
taatacgactcactatagggtgcccttttggatgaagccttttccacattaacagaggagaaatgtgatgaaggcttcaaacctggcggcagcgcaaaagatg

SEQ ID NO: 241331 - DNA, 103 bp, Artificial Sequence
  Synthetic Polynucleotide
taatacgactcactatagggataaggaggttgcccttttggatgaagcctaacagaggagaaggcttatgccaaaagggaacctggcggcagcgcaaaagatg

SEQ ID NO: 241332 - DNA, 103 bp, Artificial Sequence
  Synthetic Polynucleotide
taatacgactcactatagggacgtcgatgaataaggaggttgcccttttgaacagaggagacaaaagatgaacctccttaacctggcggcagcgcaaaagatg

SEQ ID NO: 241333 - DNA, 103 bp, Artificial Sequence
  Synthetic Polynucleotide
taatacgactcactatagggcagtgtgagtacgtcgatgaataaggaggtaacagaggagaacctccatgttcatcgacaacctggcggcagcgcaaaagatg

SEQ ID NO: 241334 - DNA, 103 bp, Artificial Sequence
  Synthetic Polynucleotide
taatacgactcactatagggggtttctctccagtgtgagtacgtcgatgaaacagaggagatcatcgatgtactcacacaacctggcggcagcgcaaaagatg

SEQ ID NO: 241335 - DNA, 103 bp, Artificial Sequence
  Synthetic Polynucleotide
taatacgactcactataggggcatacatagggtttctctccagtgtgagtaacagaggagaactcacatgggagagaaaaacctggcggcagcgcaaaagatg

SEQ ID NO: 241336 - DNA, 103 bp, Artificial Sequence
  Synthetic Polynucleotide
taatacgactcactatagggcacattcattgcatacatagggtttctctcaacagaggagagagagaatgcctatgtataacctggcggcagcgcaaaagatg

SEQ ID NO: 241337 - DNA, 103 bp, Artificial Sequence
  Synthetic Polynucleotide
taatacgactcactatagggaagcctttcccacattcattgcatacatagaacagaggagactatgtatgcaatgaatgaacctggcggcagcgcaaaagatg

SEQ ID NO: 241338 - DNA, 103 bp, Artificial Sequence
  Synthetic Polynucleotide
taatacgactcactatagggttgataccccactgacacgaggttgctataaacagaggagatatagcatgctcgtgtcaaacctggcggcagcgcaaaagatg

SEQ ID NO: 241339 - DNA, 103 bp, Artificial Sequence
  Synthetic Polynucleotide
taatacgactcactatagggcttctggctgaagcctttcccacattcattaacagaggagaaatgaaatggggaaaggcaacctggcggcagcgcaaaagatg

SEQ ID NO: 241340 - DNA, 103 bp, Artificial Sequence
  Synthetic Polynucleotide
taatacgactcactatagggttaaacatgtcttctggctgaagcctttccaacagaggagaggaaagatgtcagccagaaacctggcggcagcgcaaaagatg

SEQ ID NO: 241341 - DNA, 103 bp, Artificial Sequence
  Synthetic Polynucleotide
taatacgactcactatagggtgatgggatattaaacatgtcttctggctgaacagaggagacagccaatggacatgtttaacctggcggcagcgcaaaagatg

SEQ ID NO: 241342 - DNA, 103 bp, Artificial Sequence
  Synthetic Polynucleotide
taatacgactcactataggggtgaaatctctgatgggatattaaacatgtaacagaggagaacatgtatgatatcccataacctggcggcagcgcaaaagatg

SEQ ID NO: 241343 - DNA, 103 bp, Artificial Sequence
  Synthetic Polynucleotide
taatacgactcactatagggtctttcctgtgtgaaatctctgatgggataaacagaggagatatcccatgagagatttcaacctggcggcagcgcaaaagatg

SEQ ID NO: 241344 - DNA, 103 bp, Artificial Sequence
  Synthetic Polynucleotide
taatacgactcactatagggacaaagggtgtctttcctgtgtgaaatctcaacagaggagagagattatgcacaggaaaaacctggcggcagcgcaaaagatg

SEQ ID NO: 241345 - DNA, 103 bp, Artificial Sequence
  Synthetic Polynucleotide
taatacgactcactatagggctcagtacatacaaagggtgtctttcctgtaacagaggagaacaggaatgacaccctttaacctggcggcagcgcaaaagatg

SEQ ID NO: 241346 - DNA, 103 bp, Artificial Sequence
  Synthetic Polynucleotide
taatacgactcactatagggattttccacactcagtacatacaaagggtgaacagaggagacaccctatgtatgtactgaacctggcggcagcgcaaaagatg

SEQ ID NO: 241347 - DNA, 103 bp, Artificial Sequence
  Synthetic Polynucleotide
taatacgactcactatagggtgtgagcaggattttccacactcagtacataacagaggagaatgtacatggtgtggaaaaacctggcggcagcgcaaaagatg

SEQ ID NO: 241348 - DNA, 103 bp, Artificial Sequence
  Synthetic Polynucleotide
taatacgactcactatagggacctgacttgtgtgagcaggattttccacaaacagaggagatgtggaatgtcctgctcaaacctggcggcagcgcaaaagatg

SEQ ID NO: 241349 - DNA, 103 bp, Artificial Sequence
  Synthetic Polynucleotide
taatacgactcactataggggtttgctggcttgataccccactgacacgaaacagaggagatcgtgtatgtggggtatcaacctggcggcagcgcaaaagatg

SEQ ID NO: 241350 - DNA, 103 bp, Artificial Sequence
  Synthetic Polynucleotide
taatacgactcactatagggggttaatgagacctgacttgtgtgagcaggaacagaggagacctgctatgacaagtcagaacctggcggcagcgcaaaagatg

SEQ ID NO: 241351 - DNA, 103 bp, Artificial Sequence
  Synthetic Polynucleotide
taatacgactcactatagggattctctggtggttaatgagacctgacttgaacagaggagacaagtcatgtctcattaaaacctggcggcagcgcaaaagatg

SEQ ID NO: 241352 - DNA, 103 bp, Artificial Sequence
  Synthetic Polynucleotide
taatacgactcactatagggtcctgtgtgaattctctggtggttaatgagaacagaggagactcattatgcaccagagaaacctggcggcagcgcaaaagatg

SEQ ID NO: 241353 - DNA, 103 bp, Artificial Sequence
  Synthetic Polynucleotide
taatacgactcactatagggagggtttctctcctgtgtgaattctctggtaacagaggagaaccagaatgttcacacagaacctggcggcagcgcaaaagatg

SEQ ID NO: 241354 - DNA, 103 bp, Artificial Sequence
  Synthetic Polynucleotide
taatacgactcactatagggctgcatgtatagggtttctctcctgtgtgaaacagaggagatcacacatgagagaaaccaacctggcggcagcgcaaaagatg

SEQ ID NO: 241355 - DNA, 103 bp, Artificial Sequence
  Synthetic Polynucleotide
taatacgactcactatagggcccacagtcactgcatgtatagggtttctcaacagaggagagagaaaatgtatacatgcaacctggcggcagcgcaaaagatg

SEQ ID NO: 241356 - DNA, 103 bp, Artificial Sequence
  Synthetic Polynucleotide
taatacgactcactatagggtgaaagctttcccacagtcactgcatgtataacagaggagaatacatatggtgactgtgaacctggcggcagcgcaaaagatg

SEQ ID NO: 241357 - DNA, 103 bp, Artificial Sequence
  Synthetic Polynucleotide
taatacgactcactataggggatttatctctgaaagctttcccacagtcaaacagaggagatgactgatggaaagctttaacctggcggcagcgcaaaagatg

SEQ ID NO: 241358 - DNA, 103 bp, Artificial Sequence
  Synthetic Polynucleotide
taatacgactcactataggggttgagacatgatttatctctgaaagctttaacagaggagaaaagctatgagagataaaaacctggcggcagcgcaaaagatg

SEQ ID NO: 241359 - DNA, 103 bp, Artificial Sequence
  Synthetic Polynucleotide
taatacgactcactatagggtccgatgtctgttgagacatgatttatctcaacagaggagagagataatgcatgtctcaaacctggcggcagcgcaaaagatg

SEQ ID NO: 241360 - DNA, 103 bp, Artificial Sequence
  Synthetic Polynucleotide
taatacgactcactatagggagtgcatctggtttgctggcttgataccccaacagaggagaggggtaatgagccagcaaaacctggcggcagcgcaaaagatg

SEQ ID NO: 241361 - DNA, 103 bp, Artificial Sequence
  Synthetic Polynucleotide
taatacgactcactataggggtatgagttctccgatgtctgttgagacataacagaggagaatgtctatgcagacatcgaacctggcggcagcgcaaaagatg

SEQ ID NO: 241362 - DNA, 103 bp, Artificial Sequence
  Synthetic Polynucleotide
taatacgactcactatagggtctctcccctgtatgagttctccgatgtctaacagaggagaagacatatgagaactcataacctggcggcagcgcaaaagatg

SEQ ID NO: 241363 - DNA, 103 bp, Artificial Sequence
  Synthetic Polynucleotide
taatacgactcactatagggatccatacggtctctcccctgtatgagttcaacagaggagagaactcatgcaggggagaaacctggcggcagcgcaaaagatg

SEQ ID NO: 241364 - DNA, 103 bp, Artificial Sequence
  Synthetic Polynucleotide
taatacgactcactatagggcaatcagagcatccatacggtctctcccctaacagaggagaaggggaatgaccgtatggaacctggcggcagcgcaaaagatg

SEQ ID NO: 241365 - DNA, 103 bp, Artificial Sequence
  Synthetic Polynucleotide
taatacgactcactatagggagctttcccacaatcagagcatccatacggaacagaggagaccgtatatgtgctctgataacctggcggcagcgcaaaagatg

SEQ ID NO: 241366 - DNA, 103 bp, Artificial Sequence
  Synthetic Polynucleotide
taatacgactcactatagggagtgggagaaagctttcccacaatcagagcaacagaggagagctctgatggtgggaaagaacctggcggcagcgcaaaagatg

SEQ ID NO: 241367 - DNA, 103 bp, Artificial Sequence
  Synthetic Polynucleotide
taatacgactcactatagggaggcatgacaagtgggagaaagctttcccaaacagaggagatgggaaatgtttctcccaaacctggcggcagcgcaaaagatg

SEQ ID NO: 241368 - DNA, 103 bp, Artificial Sequence
  Synthetic Polynucleotide
taatacgactcactatagggatgataaacaaggcatgacaagtgggagaaaacagaggagattctccatgttgtcatgcaacctggcggcagcgcaaaagatg

SEQ ID NO: 241369 - DNA, 103 bp, Artificial Sequence
  Synthetic Polynucleotide
taatacgactcactataggggcattcccttatgataaacaaggcatgacaaacagaggagatgtcatatgttgtttatcaacctggcggcagcgcaaaagatg

SEQ ID NO: 241370 - DNA, 103 bp, Artificial Sequence
  Synthetic Polynucleotide
taatacgactcactatagggcttgcatgcagcattcccttatgataaacaaacagaggagatgtttaatgtaagggaataacctggcggcagcgcaaaagatg

SEQ ID NO: 241371 - DNA, 103 bp, Artificial Sequence
  Synthetic Polynucleotide
taatacgactcactatagggcaacttgaagagtgcatctggtttgctggcaacagaggagagccagcatgccagatgcaaacctggcggcagcgcaaaagatg

SEQ ID NO: 241372 - DNA, 103 bp, Artificial Sequence
  Synthetic Polynucleotide
taatacgactcactatagggacatttctctcttgcatgcagcattcccttaacagaggagaaagggaatgctgcatgcaaacctggcggcagcgcaaaagatg

SEQ ID NO: 241373 - DNA, 103 bp, Artificial Sequence
  Synthetic Polynucleotide
taatacgactcactatagggctgaacctacacatttctctcttgcatgcaaacagaggagatgcatgatggagagaaataacctggcggcagcgcaaaagatg

SEQ ID NO: 241374 - DNA, 103 bp, Artificial Sequence
  Synthetic Polynucleotide
taatacgactcactatagggtccaatttgactgaacctacacatttctctaacagaggagaagagaaatgtgtaggttcaacctggcggcagcgcaaaagatg

SEQ ID NO: 241375 - DNA, 103 bp, Artificial Sequence
  Synthetic Polynucleotide
taatacgactcactataggggcaaggattttccaatttgactgaacctacaacagaggagagtaggtatggtcaaattgaacctggcggcagcgcaaaagatg

SEQ ID NO: 241376 - DNA, 103 bp, Artificial Sequence
  Synthetic Polynucleotide
taatacgactcactataggggactctctgagcaaggattttccaatttgaaacagaggagatcaaatatgaaaatccttaacctggcggcagcgcaaaagatg

SEQ ID NO: 241377 - DNA, 103 bp, Artificial Sequence
  Synthetic Polynucleotide
taatacgactcactataggggataagctatgactctctgagcaaggatttaacagaggagaaaatccatgctcagagagaacctggcggcagcgcaaaagatg

SEQ ID NO: 241378 - DNA, 103 bp, Artificial Sequence
  Synthetic Polynucleotide
taatacgactcactatagggacgtgtatgtgataagctatgactctctgaaacagaggagatcagagatgcatagcttaaacctggcggcagcgcaaaagatg

SEQ ID NO: 241379 - DNA, 103 bp, Artificial Sequence
  Synthetic Polynucleotide
taatacgactcactataggggtatgagatcacgtgtatgtgataagctataacagaggagaatagctatgcacatacacaacctggcggcagcgcaaaagatg

SEQ ID NO: 241380 - DNA, 103 bp, Artificial Sequence
  Synthetic Polynucleotide
taatacgactcactatagggtctttatcctgtatgagatcacgtgtatgtaacagaggagaacatacatgtgatctcataacctggcggcagcgcaaaagatg

SEQ ID NO: 241381 - DNA, 103 bp, Artificial Sequence
  Synthetic Polynucleotide
taatacgactcactataggggttaacagagtctttatcctgtatgagatcaacagaggagagatctcatgcaggataaaaacctggcggcagcgcaaaagatg

SEQ ID NO: 241382 - DNA, 103 bp, Artificial Sequence
  Synthetic Polynucleotide
taatacgactcactatagggctccttgttccaacttgaagagtgcatctgaacagaggagacagatgatgtcttcaagtaacctggcggcagcgcaaaagatg

SEQ ID NO: 241383 - DNA, 103 bp, Artificial Sequence
  Synthetic Polynucleotide
taatacgactcactataggggagtcaccatgttaacagagtctttatcctaacagaggagaaggataatgactctgttaaacctggcggcagcgcaaaagatg

SEQ ID NO: 241384 - DNA, 103 bp, Artificial Sequence
  Synthetic Polynucleotide
taatacgactcactatagggggcatctgcagagtcaccatgttaacagagaacagaggagactctgtatgcatggtgacaacctggcggcagcgcaaaagatg

SEQ ID NO: 241385 - DNA, 103 bp, Artificial Sequence
  Synthetic Polynucleotide
taatacgactcactatagggtgccacagaaggcatctgcagagtcaccataacagaggagaatggtgatgctgcagatgaacctggcggcagcgcaaaagatg

SEQ ID NO: 241386 - DNA, 103 bp, Artificial Sequence
  Synthetic Polynucleotide
taatacgactcactatagggaggtctgagctgccacagaaggcatctgcaaacagaggagatgcagaatgcttctgtggaacctggcggcagcgcaaaagatg

SEQ ID NO: 241387 - DNA, 103 bp, Artificial Sequence
  Synthetic Polynucleotide
taatacgactcactatagggttagttaatgaggtctgagctgccacagaaaacagaggagattctgtatgagctcagacaacctggcggcagcgcaaaagatg

SEQ ID NO: 241388 - DNA, 103 bp, Artificial Sequence
  Synthetic Polynucleotide
taatacgactcactataggggaacgcactgttagttaatgaggtctgagcaacagaggagagctcagatgtcattaactaacctggcggcagcgcaaaagatg

SEQ ID NO: 241389 - DNA, 103 bp, Artificial Sequence
  Synthetic Polynucleotide
taatacgactcactatagggtctctgcttggaacgcactgttagttaatgaacagaggagacattaaatgacagtgcgtaacctggcggcagcgcaaaagatg

SEQ ID NO: 241390 - DNA, 103 bp, Artificial Sequence
  Synthetic Polynucleotide
taatacgactcactataggggctactttgctctctgcttggaacgcactgaacagaggagacagtgcatgccaagcagaaacctggcggcagcgcaaaagatg

SEQ ID NO: 241391 - DNA, 103 bp, Artificial Sequence
  Synthetic Polynucleotide
taatacgactcactataggggctcacaatggctactttgctctctgcttgaacagaggagacaagcaatgagcaaagtaaacctggcggcagcgcaaaagatg

SEQ ID NO: 241392 - DNA, 103 bp, Artificial Sequence
  Synthetic Polynucleotide
taatacgactcactatagggcaacaggctggctcacaatggctactttgcaacagaggagagcaaagatgccattgtgaaacctggcggcagcgcaaaagatg

SEQ ID NO: 241393 - DNA, 103 bp, Artificial Sequence
  Synthetic Polynucleotide
taatacgactcactataggggtccatggctctccttgttccaacttgaagaacagaggagacttcaaatgggaacaaggaacctggcggcagcgcaaaagatg

SEQ ID NO: 241394 - DNA, 103 bp, Artificial Sequence
  Synthetic Polynucleotide
taatacgactcactataggggaacttctggcaacaggctggctcacaatgaacagaggagacattgtatgccagcctgtaacctggcggcagcgcaaaagatg

SEQ ID NO: 241395 - DNA, 103 bp, Artificial Sequence
  Synthetic Polynucleotide
taatacgactcactatagggtgctgagactgaacttctggcaacaggctgaacagaggagacagcctatggccagaagtaacctggcggcagcgcaaaagatg

SEQ ID NO: 241396 - DNA, 103 bp, Artificial Sequence
  Synthetic Polynucleotide
taatacgactcactatagggttctactatctgctgagactgaacttctggaacagaggagaccagaaatgcagtctcagaacctggcggcagcgcaaaagatg

SEQ ID NO: 241397 - DNA, 103 bp, Artificial Sequence
  Synthetic Polynucleotide
taatacgactcactatagggtctgtgcaaattctactatctgctgagactaacagaggagaagtctcatgagatagtagaacctggcggcagcgcaaaagatg

SEQ ID NO: 241398 - DNA, 103 bp, Artificial Sequence
  Synthetic Polynucleotide
taatacgactcactatagggattttctactgtccatggctctccttgttcaacagaggagagaacaaatggagccatggaacctggcggcagcgcaaaagatg

SEQ ID NO: 241399 - DNA, 103 bp, Artificial Sequence
  Synthetic Polynucleotide
taatacgactcactatagggccacatcctccagggtcagtgattcctgggaacagaggagacccaggatgcactgacccaacctggcggcagcgcaaaagatg

SEQ ID NO: 241400 - DNA, 103 bp, Artificial Sequence
  Synthetic Polynucleotide
taatacgactcactatagggtgtggatttcattttctactgtccatggctaacagaggagaagccatatgcagtagaaaaacctggcggcagcgcaaaagatg

SEQ ID NO: 241401 - DNA, 103 bp, Artificial Sequence
  Synthetic Polynucleotide
taatacgactcactatagggcagatttggctgtggatttcattttctactaacagaggagaagtagaatgtgaaatccaaacctggcggcagcgcaaaagatg

SEQ ID NO: 241402 - DNA, 103 bp, Artificial Sequence
  Synthetic Polynucleotide
taatacgactcactataggggatttctggacagatttggctgtggatttcaacagaggagagaaatcatgagccaaatcaacctggcggcagcgcaaaagatg

SEQ ID NO: 241403 - DNA, 103 bp, Artificial Sequence
  Synthetic Polynucleotide
taatacgactcactatagggcaactttcttgatttctggacagatttggcaacagaggagagccaaaatggtccagaaaaacctggcggcagcgcaaaagatg

SEQ ID NO: 241404 - DNA, 103 bp, Artificial Sequence
  Synthetic Polynucleotide
taatacgactcactatagggagatgattgtcaactttcttgatttctggaaacagaggagatccagaatgcaagaaagtaacctggcggcagcgcaaaagatg

SEQ ID NO: 241405 - DNA, 103 bp, Artificial Sequence
  Synthetic Polynucleotide
taatacgactcactataggggtgcatctgtagatgattgtcaactttcttaacagaggagaaagaaaatggacaatcataacctggcggcagcgcaaaagatg

SEQ ID NO: 241406 - DNA, 103 bp, Artificial Sequence
  Synthetic Polynucleotide
taatacgactcactataggggcttttgtgagtgcatctgtagatgattgtaacagaggagaacaatcatgtacagatgcaacctggcggcagcgcaaaagatg

SEQ ID NO: 241407 - DNA, 103 bp, Artificial Sequence
  Synthetic Polynucleotide
taatacgactcactatagggagacatctttgcttttgtgagtgcatctgtaacagaggagaacagatatgctcacaaaaaacctggcggcagcgcaaaagatg

SEQ ID NO: 241408 - DNA, 103 bp, Artificial Sequence
  Synthetic Polynucleotide
taatacgactcactatagggcactctcttcagacatctttgcttttgtgaaacagaggagatcacaaatgcaaagatgtaacctggcggcagcgcaaaagatg

SEQ ID NO: 241409 - DNA, 103 bp, Artificial Sequence
  Synthetic Polynucleotide
taatacgactcactatagggggcattgttccactctcttcagacatctttaacagaggagaaaagatatgtgaagagagaacctggcggcagcgcaaaagatg

SEQ ID NO: 241410 - DNA, 103 bp, Artificial Sequence
  Synthetic Polynucleotide
taatacgactcactatagggaactccacagccacatcctccagggtcagtaacagaggagaactgacatgggaggatgtaacctggcggcagcgcaaaagatg

SEQ ID NO: 241411 - DNA, 103 bp, Artificial Sequence
  Synthetic Polynucleotide
taatacgactcactatagggttatgtttatggcattgttccactctcttcaacagaggagagaagagatgggaacaatgaacctggcggcagcgcaaaagatg

SEQ ID NO: 241412 - DNA, 103 bp, Artificial Sequence
  Synthetic Polynucleotide
taatacgactcactatagggtccaaatgcattatgtttatggcattgttcaacagaggagagaacaaatgcataaacataacctggcggcagcgcaaaagatg

SEQ ID NO: 241413 - DNA, 103 bp, Artificial Sequence
  Synthetic Polynucleotide
taatacgactcactataggggaatgatgtttccaaatgcattatgtttataacagaggagaataaacatgatgcatttgaacctggcggcagcgcaaaagatg

SEQ ID NO: 241414 - DNA, 103 bp, Artificial Sequence
  Synthetic Polynucleotide
taatacgactcactatagggttcctctgatgaatgatgtttccaaatgcaaacagaggagatgcattatgaaacatcataacctggcggcagcgcaaaagatg

SEQ ID NO: 241415 - DNA, 103 bp, Artificial Sequence
  Synthetic Polynucleotide
taatacgactcactatagggaaaatcacttttcctctgatgaatgatgttaacagaggagaaacatcatgcatcagaggaacctggcggcagcgcaaaagatg

SEQ ID NO: 241416 - DNA, 103 bp, Artificial Sequence
  Synthetic Polynucleotide
taatacgactcactataggggccttaaaggaaaatcacttttcctctgataacagaggagaatcagaatgaaagtgattaacctggcggcagcgcaaaagatg

SEQ ID NO: 241417 - DNA, 103 bp, Artificial Sequence
  Synthetic Polynucleotide
taatacgactcactatagggtcatgattttgccttaaaggaaaatcacttaacagaggagaaagtgaatgtcctttaagaacctggcggcagcgcaaaagatg

SEQ ID NO: 241418 - DNA, 103 bp, Artificial Sequence
  Synthetic Polynucleotide
taatacgactcactataggggtcaaatgtatcatgattttgccttaaaggaacagaggagacctttaatgcaaaatcataacctggcggcagcgcaaaagatg

SEQ ID NO: 241419 - DNA, 103 bp, Artificial Sequence
  Synthetic Polynucleotide
taatacgactcactatagggtcccatgtaagtcaaatgtatcatgattttaacagaggagaaaaatcatgatacatttgaacctggcggcagcgcaaaagatg

SEQ ID NO: 241420 - DNA, 103 bp, Artificial Sequence
  Synthetic Polynucleotide
taatacgactcactatagggttcagtattttcccatgtaagtcaaatgtaaacagaggagatacattatgcttacatggaacctggcggcagcgcaaaagatg

SEQ ID NO: 241421 - DNA, 103 bp, Artificial Sequence
  Synthetic Polynucleotide
taatacgactcactatagggctcccaagtgaactccacagccacatcctcaacagaggagagaggatatggctgtggagaacctggcggcagcgcaaaagatg

SEQ ID NO: 241422 - DNA, 103 bp, Artificial Sequence
  Synthetic Polynucleotide
taatacgactcactatagggtaaatttgatttcagtattttcccatgtaaaacagaggagattacatatgaaaatactgaacctggcggcagcgcaaaagatg

SEQ ID NO: 241423 - DNA, 103 bp, Artificial Sequence
  Synthetic Polynucleotide
taatacgactcactatagggtgactaaacttaaatttgatttcagtatttaacagaggagaaaatacatgaatcaaattaacctggcggcagcgcaaaagatg

SEQ ID NO: 241424 - DNA, 103 bp, Artificial Sequence
  Synthetic Polynucleotide
taatacgactcactatagggttgttctggttgactaaacttaaatttgataacagaggagaatcaaaatgaagtttagtaacctggcggcagcgcaaaagatg

SEQ ID NO: 241425 - DNA, 103 bp, Artificial Sequence
  Synthetic Polynucleotide
taatacgactcactatagggttcataccttttgttctggttgactaaactaacagaggagaagtttaatgaaccagaacaacctggcggcagcgcaaaagatg

SEQ ID NO: 241426 - DNA, 103 bp, Artificial Sequence
  Synthetic Polynucleotide
taatacgactcactatagggaattcttgatttcataccttttgttctggtaacagaggagaaccagaatgaaaggtatgaacctggcggcagcgcaaaagatg

SEQ ID NO: 241427 - DNA, 103 bp, Artificial Sequence
  Synthetic Polynucleotide
taatacgactcactatagggacccccacagaattcttgatttcataccttaacagaggagaaaggtaatgaatcaagaaaacctggcggcagcgcaaaagatg

SEQ ID NO: 241428 - DNA, 103 bp, Artificial Sequence
  Synthetic Polynucleotide
taatacgactcactatagggatctccattaacccccacagaattcttgataacagaggagaatcaagatgtctgtggggaacctggcggcagcgcaaaagatg

SEQ ID NO: 241429 - DNA, 103 bp, Artificial Sequence
  Synthetic Polynucleotide
taatacgactcactatagggaggatttcccatctccattaacccccacagaacagaggagactgtggatgttaatggagaacctggcggcagcgcaaaagatg

SEQ ID NO: 241430 - DNA, 103 bp, Artificial Sequence
  Synthetic Polynucleotide
taatacgactcactataggggcatgaaggaaggatttcccatctccattaaacagaggagataatggatgtgggaaatcaacctggcggcagcgcaaaagatg

SEQ ID NO: 241431 - DNA, 103 bp, Artificial Sequence
  Synthetic Polynucleotide
taatacgactcactatagggttcatgcttggcatgaaggaaggatttcccaacagaggagagggaaaatgttccttcataacctggcggcagcgcaaaagatg

SEQ ID NO: 241432 - DNA, 103 bp, Artificial Sequence
  Synthetic Polynucleotide
taatacgactcactataggggctgccactcctcccaagtgaactccacagaacagaggagactgtggatgtcacttgggaacctggcggcagcgcaaaagatg

SEQ ID NO: 241433 - DNA, 103 bp, Artificial Sequence
  Synthetic Polynucleotide
taatacgactcactatagggtatgaaattgttcatgcttggcatgaaggaaacagaggagatccttcatgccaagcatgaacctggcggcagcgcaaaagatg

SEQ ID NO: 241434 - DNA, 103 bp, Artificial Sequence
  Synthetic Polynucleotide
taatacgactcactatagggttcatttcattatgaaattgttcatgcttgaacagaggagacaagcaatgacaatttcaaacctggcggcagcgcaaaagatg

SEQ ID NO: 241435 - DNA, 103 bp, Artificial Sequence
  Synthetic Polynucleotide
taatacgactcactatagggttcggggaagttcatttcattatgaaattgaacagaggagacaatttatgaatgaaatgaacctggcggcagcgcaaaagatg

SEQ ID NO: 241436 - DNA, 103 bp, Artificial Sequence
  Synthetic Polynucleotide
taatacgactcactatagggaatttccaccttcggggaagttcatttcataacagaggagaatgaaaatgacttccccgaacctggcggcagcgcaaaagatg

SEQ ID NO: 241437 - DNA, 103 bp, Artificial Sequence
  Synthetic Polynucleotide
taatacgactcactataggggtattcacagaatttccaccttcggggaagaacagaggagacttcccatgaggtggaaaaacctggcggcagcgcaaaagatg

SEQ ID NO: 241438 - DNA, 103 bp, Artificial Sequence
  Synthetic Polynucleotide
taatacgactcactatagggttgtgaatttgtattcacagaatttccaccaacagaggagaggtggaatgtctgtgaataacctggcggcagcgcaaaagatg

SEQ ID NO: 241439 - DNA, 103 bp, Artificial Sequence
  Synthetic Polynucleotide
taatacgactcactataggggcttaatgaattgtgaatttgtattcacagaacagaggagactgtgaatgcaaattcacaacctggcggcagcgcaaaagatg

SEQ ID NO: 241440 - DNA, 103 bp, Artificial Sequence
  Synthetic Polynucleotide
taatacgactcactataggggttcgctgatgcttaatgaattgtgaatttaacagaggagaaaattcatgattcattaaaacctggcggcagcgcaaaagatg

SEQ ID NO: 241441 - DNA, 103 bp, Artificial Sequence
  Synthetic Polynucleotide
taatacgactcactatagggtatgttttgagttcgctgatgcttaatgaaaacagaggagattcattatgcatcagcgaaacctggcggcagcgcaaaagatg

SEQ ID NO: 241442 - DNA, 103 bp, Artificial Sequence
  Synthetic Polynucleotide
taatacgactcactatagggggggtttatctatgttttgagttcgctgataacagaggagaatcagcatgctcaaaacaaacctggcggcagcgcaaaagatg

SEQ ID NO: 241443 - DNA, 103 bp, Artificial Sequence
  Synthetic Polynucleotide
taatacgactcactataggggggccgaggagctgccactcctcccaagtgaacagaggagacacttgatgggagtggcaaacctggcggcagcgcaaaagatg

SEQ ID NO: 241444 - DNA, 103 bp, Artificial Sequence
  Synthetic Polynucleotide
taatacgactcactataggggtgcatacatggggtttatctatgttttgaaacagaggagatcaaaaatgagataaaccaacctggcggcagcgcaaaagatg

SEQ ID NO: 241445 - DNA, 103 bp, Artificial Sequence
  Synthetic Polynucleotide
taatacgactcactatagggcccacactcagtgcatacatggggtttatcaacagaggagagataaaatgcatgtatgcaacctggcggcagcgcaaaagatg

SEQ ID NO: 241446 - DNA, 103 bp, Artificial Sequence
  Synthetic Polynucleotide
taatacgactcactatagggggaaagccttcccacactcagtgcatacataacagaggagaatgtatatgctgagtgtgaacctggcggcagcgcaaaagatg

SEQ ID NO: 241447 - DNA, 103 bp, Artificial Sequence
  Synthetic Polynucleotide
taatacgactcactataggggacttcttgaggaaagccttcccacactcaaacagaggagatgagtgatggaaggctttaacctggcggcagcgcaaaagatg

SEQ ID NO: 241448 - DNA, 103 bp, Artificial Sequence
  Synthetic Polynucleotide
taatacgactcactataggggatgaggcgagacttcttgaggaaagccttaacagaggagaaaggctatgctcaagaagaacctggcggcagcgcaaaagatg

SEQ ID NO: 241449 - DNA, 103 bp, Artificial Sequence
  Synthetic Polynucleotide
taatacgactcactatagggtctgatgatagatgaggcgagacttcttgaaacagaggagatcaagaatgctcgcctcaaacctggcggcagcgcaaaagatg

SEQ ID NO: 241450 - DNA, 103 bp, Artificial Sequence
  Synthetic Polynucleotide
taatacgactcactataggggtgtgaactctctgatgatagatgaggcgaaacagaggagatcgcctatgctatcatcaaacctggcggcagcgcaaaagatg

SEQ ID NO: 241451 - DNA, 103 bp, Artificial Sequence
  Synthetic Polynucleotide
taatacgactcactatagggtttctccccagtgtgaactctctgatgataaacagaggagatatcatatgagagttcacaacctggcggcagcgcaaaagatg

SEQ ID NO: 241452 - DNA, 103 bp, Artificial Sequence
  Synthetic Polynucleotide
taatacgactcactatagggatccatgaggtttctccccagtgtgaactcaacagaggagagagttcatgctggggagaaacctggcggcagcgcaaaagatg

SEQ ID NO: 241453 - DNA, 103 bp, Artificial Sequence
  Synthetic Polynucleotide
taatacgactcactatagggcatatactgcatccatgaggtttctccccaaacagaggagatggggaatgacctcatggaacctggcggcagcgcaaaagatg

SEQ ID NO: 241454 - DNA, 103 bp, Artificial Sequence
  Synthetic Polynucleotide
taatacgactcactatagggcttctgagcagggccgaggagctgccactcaacagaggagagagtggatgctcctcggcaacctggcggcagcgcaaaagatg

SEQ ID NO: 241455 - DNA, 103 bp, Artificial Sequence
  Synthetic Polynucleotide
taatacgactcactatagggggctttcccacatatactgcatccatgaggaacagaggagacctcatatgtgcagtataaacctggcggcagcgcaaaagatg

SEQ ID NO: 241456 - DNA, 103 bp, Artificial Sequence
  Synthetic Polynucleotide
taatacgactcactatagggttctggagaaggctttcccacatatactgcaacagaggagagcagtaatggtgggaaagaacctggcggcagcgcaaaagatg

SEQ ID NO: 241457 - DNA, 103 bp, Artificial Sequence
  Synthetic Polynucleotide
taatacgactcactatagggagcccggactttctggagaaggctttcccaaacagaggagatgggaaatgcttctccagaacctggcggcagcgcaaaagatg

SEQ ID NO: 241458 - DNA, 103 bp, Artificial Sequence
  Synthetic Polynucleotide
taatacgactcactataggggtgttcagtgagcccggactttctggagaaaacagaggagattctccatgaagtccgggaacctggcggcagcgcaaaagatg

SEQ ID NO: 241459 - DNA, 103 bp, Artificial Sequence
  Synthetic Polynucleotide
taatacgactcactatagggggtttctctggtgttcagtgagcccggactaacagaggagaagtccgatgtcactgaacaacctggcggcagcgcaaaagatg

SEQ ID NO: 241460 - DNA, 103 bp, Artificial Sequence
  Synthetic Polynucleotide
taatacgactcactatagggtctcctgtgtggtttctctggtgttcagtgaacagaggagacactgaatgccagagaaaaacctggcggcagcgcaaaagatg

SEQ ID NO: 241461 - DNA, 103 bp, Artificial Sequence
  Synthetic Polynucleotide
taatacgactcactatagggatagggtttctctcctgtgtggtttctctgaacagaggagacagagaatgcacacaggaaacctggcggcagcgcaaaagatg

SEQ ID NO: 241462 - DNA, 103 bp, Artificial Sequence
  Synthetic Polynucleotide
taatacgactcactatagggcagtgcattcatagggtttctctcctgtgtaacagaggagaacacagatgagaaaccctaacctggcggcagcgcaaaagatg

SEQ ID NO: 241463 - DNA, 103 bp, Artificial Sequence
  Synthetic Polynucleotide
taatacgactcactatagggttgtcacattcagtgcattcatagggtttcaacagaggagagaaaccatgtgaatgcacaacctggcggcagcgcaaaagatg

SEQ ID NO: 241464 - DNA, 103 bp, Artificial Sequence
  Synthetic Polynucleotide
taatacgactcactataggggcggaatgctttgtcacattcagtgcattcaacagaggagagaatgcatggaatgtgacaacctggcggcagcgcaaaagatg

SEQ ID NO: 241465 - DNA, 103 bp, Artificial Sequence
  Synthetic Polynucleotide
taatacgactcactatagggggtacaggtccttctgagcagggccgaggaaacagaggagatcctcgatgctgctcagaaacctggcggcagcgcaaaagatg

SEQ ID NO: 241466 - DNA, 103 bp, Artificial Sequence
  Synthetic Polynucleotide
taatacgactcactataggggtgatttccagcggaatgctttgtcacattaacagaggagaaatgtgatgaagcattccaacctggcggcagcgcaaaagatg

SEQ ID NO: 241467 - DNA, 103 bp, Artificial Sequence
  Synthetic Polynucleotide
taatacgactcactataggggcattgagctgtgatttccagcggaatgctaacagaggagaagcattatgctggaaatcaacctggcggcagcgcaaaagatg

SEQ ID NO: 241468 - DNA, 103 bp, Artificial Sequence
  Synthetic Polynucleotide
taatacgactcactatagggtttctggtgtgcattgagctgtgatttccaaacagaggagatggaaaatgcagctcaataacctggcggcagcgcaaaagatg

SEQ ID NO: 241469 - DNA, 103 bp, Artificial Sequence
  Synthetic Polynucleotide
taatacgactcactatagggctgtatgaattttctggtgtgcattgagctaacagaggagaagctcaatgcacaccagaaacctggcggcagcgcaaaagatg

SEQ ID NO: 241470 - DNA, 103 bp, Artificial Sequence
  Synthetic Polynucleotide
taatacgactcactataggggacttctctcctgtatgaattttctggtgtaacagaggagaacaccaatgaattcatacaacctggcggcagcgcaaaagatg

SEQ ID NO: 241471 - DNA, 103 bp, Artificial Sequence
  Synthetic Polynucleotide
taatacgactcactataggggcatatatatgacttctctcctgtatgaataacagaggagaattcatatgggagagaagaacctggcggcagcgcaaaagatg

SEQ ID NO: 241472 - DNA, 103 bp, Artificial Sequence
  Synthetic Polynucleotide
taatacgactcactatagggcacaatcactgcatatatatgacttctctcaacagaggagagagagaatgcatatatataacctggcggcagcgcaaaagatg

SEQ ID NO: 241473 - DNA, 103 bp, Artificial Sequence
  Synthetic Polynucleotide
taatacgactcactatagggaagccttttccacaatcactgcatatatataacagaggagaatatatatgcagtgattgaacctggcggcagcgcaaaagatg

SEQ ID NO: 241474 - DNA, 103 bp, Artificial Sequence
  Synthetic Polynucleotide
taatacgactcactatagggcttcttgatgaagccttttccacaatcactaacagaggagaagtgatatgggaaaaggcaacctggcggcagcgcaaaagatg

SEQ ID NO: 241475 - DNA, 103 bp, Artificial Sequence
  Synthetic Polynucleotide
taatacgactcactatagggtgagccgagacttcttgatgaagccttttcaacagaggagagaaaagatgtcatcaagaaacctggcggcagcgcaaaagatg

SEQ ID NO: 241476 - DNA, 103 bp, Artificial Sequence
  Synthetic Polynucleotide
taatacgactcactatagggatcacgtctcggtacaggtccttctgagcaaacagaggagatgctcaatgggacctgtaaacctggcggcagcgcaaaagatg

SEQ ID NO: 241477 - DNA, 103 bp, Artificial Sequence
  Synthetic Polynucleotide
taatacgactcactatagggtgatgattaatgagccgagacttcttgatgaacagaggagacatcaaatggtctcggctaacctggcggcagcgcaaaagatg

SEQ ID NO: 241478 - DNA, 103 bp, Artificial Sequence
  Synthetic Polynucleotide
taatacgactcactatagggatgaactctctgatgattaatgagccgagaaacagaggagatctcggatgattaatcataacctggcggcagcgcaaaagatg

SEQ ID NO: 241479 - DNA, 103 bp, Artificial Sequence
  Synthetic Polynucleotide
taatacgactcactatagggtctctcctgtatgaactctctgatgattaaaacagaggagattaatcatgagagagttcaacctggcggcagcgcaaaagatg

SEQ ID NO: 241480 - DNA, 103 bp, Artificial Sequence
  Synthetic Polynucleotide
taatacgactcactatagggccatgtggtttctctcctgtatgaactctcaacagaggagagagagtatgtacaggagaaacctggcggcagcgcaaaagatg

SEQ ID NO: 241481 - DNA, 103 bp, Artificial Sequence
  Synthetic Polynucleotide
taatacgactcactatagggcaggctgcatccatgtggtttctctcctgtaacagaggagaacaggaatgaaaccacataacctggcggcagcgcaaaagatg

SEQ ID NO: 241482 - DNA, 103 bp, Artificial Sequence
  Synthetic Polynucleotide
taatacgactcactatagggccttcccacacaggctgcatccatgtggttaacagaggagaaaccacatggatgcagccaacctggcggcagcgcaaaagatg

SEQ ID NO: 241483 - DNA, 103 bp, Artificial Sequence
  Synthetic Polynucleotide
taatacgactcactatagggttggagaaggccttcccacacaggctgcataacagaggagaatgcagatggtgtgggaaaacctggcggcagcgcaaaagatg

SEQ ID NO: 241484 - DNA, 103 bp, Artificial Sequence
  Synthetic Polynucleotide
taatacgactcactatagggcctggaccttttggagaaggccttcccacaaacagaggagatgtgggatggccttctccaacctggcggcagcgcaaaagatg

SEQ ID NO: 241485 - DNA, 103 bp, Artificial Sequence
  Synthetic Polynucleotide
taatacgactcactataggggttcagtgagcctggaccttttggagaaggaacagaggagaccttctatgaaaggtccaaacctggcggcagcgcaaaagatg

SEQ ID NO: 241486 - DNA, 103 bp, Artificial Sequence
  Synthetic Polynucleotide
taatacgactcactataggggttctctggtgttcagtgagcctggaccttaacagaggagaaaggtcatggctcactgaaacctggcggcagcgcaaaagatg

SEQ ID NO: 241487 - DNA, 103 bp, Artificial Sequence
  Synthetic Polynucleotide
taatacgactcactatagggcctttttctttttttaggatactcattcataacagaggagaatgaatatgtatcctaaaaacctggcggcagcgcaaaagatg

SEQ ID NO: 241488 - DNA, 103 bp, Artificial Sequence
  Synthetic Polynucleotide
taatacgactcactataggggtaacaatgatcagagaaaattccattgaaaacagaggagattcaatatgattttctctaacctggcggcagcgcaaaagatg

SEQ ID NO: 241489 - DNA, 103 bp, Artificial Sequence
  Synthetic Polynucleotide
taatacgactcactatagggatgctcatttaccacatggctatgcaagtcaacagaggagagacttgatgagccatgtgaacctggcggcagcgcaaaagatg

SEQ ID NO: 241490 - DNA, 103 bp, Artificial Sequence
  Synthetic Polynucleotide
taatacgactcactatagggatttacatgcatgctcatttaccacatggcaacagaggagagccatgatgtaaatgagcaacctggcggcagcgcaaaagatg

SEQ ID NO: 241491 - DNA, 103 bp, Artificial Sequence
  Synthetic Polynucleotide
taatacgactcactatagggaactctattaatttacatgcatgctcatttaacagaggagaaaatgaatgtgcatgtaaaacctggcggcagcgcaaaagatg

SEQ ID NO: 241492 - DNA, 103 bp, Artificial Sequence
  Synthetic Polynucleotide
taatacgactcactatagggcttatcacttaactctattaatttacatgcaacagaggagagcatgtatgttaatagagaacctggcggcagcgcaaaagatg

SEQ ID NO: 241493 - DNA, 103 bp, Artificial Sequence
  Synthetic Polynucleotide
taatacgactcactatagggcattgttatacttatcacttaactctattaaacagaggagataatagatgtaagtgataaacctggcggcagcgcaaaagatg

SEQ ID NO: 241494 - DNA, 103 bp, Artificial Sequence
  Synthetic Polynucleotide
taatacgactcactatagggccatgttcaccattgttatacttatcacttaacagaggagaaagtgaatggtataacaaaacctggcggcagcgcaaaagatg

SEQ ID NO: 241495 - DNA, 103 bp, Artificial Sequence
  Synthetic Polynucleotide
taatacgactcactataggggctatactgtccatgttcaccattgttataaacagaggagatataacatgggtgaacataacctggcggcagcgcaaaagatg

SEQ ID NO: 241496 - DNA, 103 bp, Artificial Sequence
  Synthetic Polynucleotide
taatacgactcactatagggtgcttaagaggctatactgtccatgttcacaacagaggagagtgaacatggacagtataaacctggcggcagcgcaaaagatg

SEQ ID NO: 241497 - DNA, 103 bp, Artificial Sequence
  Synthetic Polynucleotide
taatacgactcactatagggaaggtaattttgcttaagaggctatactgtaacagaggagaacagtaatgcctcttaagaacctggcggcagcgcaaaagatg

SEQ ID NO: 241498 - DNA, 103 bp, Artificial Sequence
  Synthetic Polynucleotide
taatacgactcactatagggacatttgtcaaaggtaattttgcttaagagaacagaggagactcttaatgaaaattaccaacctggcggcagcgcaaaagatg

SEQ ID NO: 241499 - DNA, 103 bp, Artificial Sequence
  Synthetic Polynucleotide
taatacgactcactatagggaacagacactgtaacaatgatcagagaaaaaacagaggagattttctatgatcattgttaacctggcggcagcgcaaaagatg

SEQ ID NO: 241500 - DNA, 103 bp, Artificial Sequence
  Synthetic Polynucleotide
taatacgactcactatagggagaagtttttacatttgtcaaaggtaatttaacagaggagaaaattaatgttgacaaataacctggcggcagcgcaaaagatg

SEQ ID NO: 241501 - DNA, 103 bp, Artificial Sequence
  Synthetic Polynucleotide
taatacgactcactatagggtgacatacaaagaagtttttacatttgtcaaacagaggagatgacaaatgtaaaaacttaacctggcggcagcgcaaaagatg

SEQ ID NO: 241502 - DNA, 103 bp, Artificial Sequence
  Synthetic Polynucleotide
taatacgactcactatagggaccacatacttgacatacaaagaagtttttaacagaggagaaaaaacatgtttgtatgtaacctggcggcagcgcaaaagatg

SEQ ID NO: 241503 - DNA, 103 bp, Artificial Sequence
  Synthetic Polynucleotide
taatacgactcactatagggtactccgaaaaccacatacttgacatacaaaacagaggagattgtatatgaagtatgtgaacctggcggcagcgcaaaagatg

SEQ ID NO: 241504 - DNA, 103 bp, Artificial Sequence
  Synthetic Polynucleotide
taatacgactcactataggggtgtgaagtctactccgaaaaccacatactaacagaggagaagtatgatgttttcggagaacctggcggcagcgcaaaagatg

SEQ ID NO: 241505 - DNA, 103 bp, Artificial Sequence
  Synthetic Polynucleotide
taatacgactcactataggggttaacatttgtgtgaagtctactccgaaaaacagaggagatttcggatgagacttcacaacctggcggcagcgcaaaagatg

SEQ ID NO: 241506 - DNA, 103 bp, Artificial Sequence
  Synthetic Polynucleotide
taatacgactcactatagggcaacatgcctgttaacatttgtgtgaagtcaacagaggagagacttcatgcaaatgttaaacctggcggcagcgcaaaagatg

SEQ ID NO: 241507 - DNA, 103 bp, Artificial Sequence
  Synthetic Polynucleotide
taatacgactcactatagggtgttcaatagcaacatgcctgttaacatttaacagaggagaaaatgtatgcaggcatgtaacctggcggcagcgcaaaagatg

SEQ ID NO: 241508 - DNA, 103 bp, Artificial Sequence
  Synthetic Polynucleotide
taatacgactcactatagggaatttttgtatgttcaatagcaacatgcctaacagaggagaaggcatatggctattgaaaacctggcggcagcgcaaaagatg

SEQ ID NO: 241509 - DNA, 103 bp, Artificial Sequence
  Synthetic Polynucleotide
taatacgactcactatagggcatgaggaaaaatttttgtatgttcaatagaacagaggagactattgatgatacaaaaaaacctggcggcagcgcaaaagatg

SEQ ID NO: 241510 - DNA, 103 bp, Artificial Sequence
  Synthetic Polynucleotide
taatacgactcactatagggtgtctcatagaacagacactgtaacaatgaaacagaggagatcattgatgcagtgtctgaacctggcggcagcgcaaaagatg

SEQ ID NO: 241511 - DNA, 103 bp, Artificial Sequence
  Synthetic Polynucleotide
taatacgactcactatagggtcatcacaaacatgaggaaaaatttttgtaaacagaggagatacaaaatgttttcctcaaacctggcggcagcgcaaaagatg

SEQ ID NO: 241512 - DNA, 103 bp, Artificial Sequence
  Synthetic Polynucleotide
taatacgactcactatagggtttcccacagtcatcacaaacatgaggaaaaacagaggagatttcctatggtttgtgataacctggcggcagcgcaaaagatg

SEQ ID NO: 241513 - DNA, 103 bp, Artificial Sequence
  Synthetic Polynucleotide
taatacgactcactatagggttgaaaagcctttcccacagtcatcacaaaaacagaggagatttgtgatgactgtgggaaacctggcggcagcgcaaaagatg

SEQ ID NO: 241514 - DNA, 103 bp, Artificial Sequence
  Synthetic Polynucleotide
taatacgactcactatagggtctagcatacttgaaaagcctttcccacagaacagaggagactgtggatgaggcttttcaacctggcggcagcgcaaaagatg

SEQ ID NO: 241515 - DNA, 103 bp, Artificial Sequence
  Synthetic Polynucleotide
taatacgactcactatagggcttgcaatattctagcatacttgaaaagccaacagaggagaggctttatgagtatgctaaacctggcggcagcgcaaaagatg

SEQ ID NO: 241516 - DNA, 103 bp, Artificial Sequence
  Synthetic Polynucleotide
taatacgactcactatagggaatttaaatgcttgcaatattctagcatacaacagaggagagtatgcatgaatattgcaaacctggcggcagcgcaaaagatg

SEQ ID NO: 241517 - DNA, 103 bp, Artificial Sequence
  Synthetic Polynucleotide
taatacgactcactataggggataaatgtgaatttaaatgcttgcaatataacagaggagaatattgatggcatttaaaaacctggcggcagcgcaaaagatg

SEQ ID NO: 241518 - DNA, 103 bp, Artificial Sequence
  Synthetic Polynucleotide
taatacgactcactatagggaatcccttcagataaatgtgaatttaaatgaacagaggagacatttaatgtcacatttaaacctggcggcagcgcaaaagatg

SEQ ID NO: 241519 - DNA, 103 bp, Artificial Sequence
  Synthetic Polynucleotide
taatacgactcactataggggacataaataaatcccttcagataaatgtgaacagaggagacacattatgctgaagggaaacctggcggcagcgcaaaagatg

SEQ ID NO: 241520 - DNA, 103 bp, Artificial Sequence
  Synthetic Polynucleotide
taatacgactcactatagggtcacaatattgacataaataaatcccttcaaacagaggagatgaaggatgttatttatgaacctggcggcagcgcaaaagatg

SEQ ID NO: 241521 - DNA, 103 bp, Artificial Sequence
  Synthetic Polynucleotide
taatacgactcactatagggtaaatctggctgtctcatagaacagacactaacagaggagaagtgtcatgtctatgagaaacctggcggcagcgcaaaagatg

SEQ ID NO: 241522 - DNA, 103 bp, Artificial Sequence
  Synthetic Polynucleotide
taatacgactcactatagggtgttgaatattcacaatattgacataaataaacagaggagatatttaatgcaatattgtaacctggcggcagcgcaaaagatg

SEQ ID NO: 241523 - DNA, 103 bp, Artificial Sequence
  Synthetic Polynucleotide
taatacgactcactatagggcaatttgtcctgttgaatattcacaatattaacagaggagaaatattatgaatattcaaaacctggcggcagcgcaaaagatg

SEQ ID NO: 241524 - DNA, 103 bp, Artificial Sequence
  Synthetic Polynucleotide
taatacgactcactatagggttaagatcttcaatttgtcctgttgaatataacagaggagaatattcatgaggacaaataacctggcggcagcgcaaaagatg

SEQ ID NO: 241525 - DNA, 103 bp, Artificial Sequence
  Synthetic Polynucleotide
taatacgactcactatagggtagatgaattttaagatcttcaatttgtccaacagaggagaggacaaatggaagatcttaacctggcggcagcgcaaaagatg

SEQ ID NO: 241526 - DNA, 103 bp, Artificial Sequence
  Synthetic Polynucleotide
taatacgactcactataggggcttgaaatctagatgaattttaagatcttaacagaggagaaagatcatgaaattcatcaacctggcggcagcgcaaaagatg

SEQ ID NO: 241527 - DNA, 103 bp, Artificial Sequence
  Synthetic Polynucleotide
taatacgactcactatagggtcagctgaatgcttgaaatctagatgaattaacagaggagaaattcaatgagatttcaaaacctggcggcagcgcaaaagatg

SEQ ID NO: 241528 - DNA, 103 bp, Artificial Sequence
  Synthetic Polynucleotide
taatacgactcactatagggatgaggcaagtcagctgaatgcttgaaatcaacagaggagagatttcatgcattcagctaacctggcggcagcgcaaaagatg

SEQ ID NO: 241529 - DNA, 103 bp, Artificial Sequence
  Synthetic Polynucleotide
taatacgactcactatagggcactacatttatgaggcaagtcagctgaataacagaggagaattcagatgacttgcctcaacctggcggcagcgcaaaagatg

SEQ ID NO: 241530 - DNA, 103 bp, Artificial Sequence
  Synthetic Polynucleotide
taatacgactcactatagggatcaagcagtcactacatttatgaggcaagaacagaggagacttgccatgtaaatgtagaacctggcggcagcgcaaaagatg

SEQ ID NO: 241531 - DNA, 103 bp, Artificial Sequence
  Synthetic Polynucleotide
taatacgactcactatagggtccaaacctcatcaagcagtcactacatttaacagaggagaaaatgtatggactgcttgaacctggcggcagcgcaaaagatg

SEQ ID NO: 241532 - DNA, 103 bp, Artificial Sequence
  Synthetic Polynucleotide
taatacgactcactatagggcaaaatattttaaatctggctgtctcatagaacagaggagactatgaatgagccagattaacctggcggcagcgcaaaagatg

SEQ ID NO: 241533 - DNA, 103 bp, Artificial Sequence
  Synthetic Polynucleotide
taatacgactcactatagggccctttcatttccaaacctcatcaagcagtaacagaggagaactgctatgtgaggtttgaacctggcggcagcgcaaaagatg

SEQ ID NO: 241534 - DNA, 103 bp, Artificial Sequence
  Synthetic Polynucleotide
taatacgactcactatagggcttattaattccctttcatttccaaacctcaacagaggagagaggttatgaaatgaaagaacctggcggcagcgcaaaagatg

SEQ ID NO: 241535 - DNA, 103 bp, Artificial Sequence
  Synthetic Polynucleotide
taatacgactcactatagggtggaaggtgacttattaattccctttcattaacagaggagaaatgaaatggaattaataaacctggcggcagcgcaaaagatg

SEQ ID NO: 241536 - DNA, 103 bp, Artificial Sequence
  Synthetic Polynucleotide
taatacgactcactatagggtctcatggactggaaggtgacttattaattaacagaggagaaattaaatggtcaccttcaacctggcggcagcgcaaaagatg

SEQ ID NO: 241537 - DNA, 103 bp, Artificial Sequence
  Synthetic Polynucleotide
taatacgactcactatagggtctttgttgtcaaaatattttaaatctggcaacagaggagagccagaatgaaaatatttaacctggcggcagcgcaaaagatg

SEQ ID NO: 241538 - DNA, 103 bp, Artificial Sequence
  Synthetic Polynucleotide
taatacgactcactatagggagaatcatcatctttgttgtcaaaatatttaacagaggagaaaatatatggacaacaaaaacctggcggcagcgcaaaagatg

SEQ ID NO: 241539 - DNA, 103 bp, Artificial Sequence
  Synthetic Polynucleotide
taatacgactcactatagggtctcggtatcagaatcatcatctttgttgtaacagaggagaacaacaatgatgatgattaacctggcggcagcgcaaaagatg

SEQ ID NO: 241540 - DNA, 103 bp, Artificial Sequence
  Synthetic Polynucleotide
taatacgactcactatagggtcatttgacgtctcggtatcagaatcatcaaacagaggagatgatgaatgtgataccgaaacctggcggcagcgcaaaagatg

SEQ ID NO: 241541 - DNA, 103 bp, Artificial Sequence
  Synthetic Polynucleotide
taatacgactcactatagggttttggcaagtcatttgacgtctcggtatcaacagaggagagataccatgacgtcaaataacctggcggcagcgcaaaagatg

SEQ ID NO: 241542 - DNA, 103 bp, Artificial Sequence
  Synthetic Polynucleotide
taatacgactcactataggggtagagtcttcctttttctttttttaggataacagaggagaatcctaatgaaagaaaaaaacctggcggcagcgcaaaagatg

SEQ ID NO: 241543 - DNA, 103 bp, Artificial Sequence
  Synthetic Polynucleotide
taatacgactcactatagggcatctgcaaattttggcaagtcatttgacgaacagaggagacgtcaaatgacttgccaaaacctggcggcagcgcaaaagatg

SEQ ID NO: 241544 - DNA, 103 bp, Artificial Sequence
  Synthetic Polynucleotide
taatacgactcactataggggccttgattccatctgcaaattttggcaagaacagaggagacttgccatgatttgcagaaacctggcggcagcgcaaaagatg

SEQ ID NO: 241545 - DNA, 103 bp, Artificial Sequence
  Synthetic Polynucleotide
taatacgactcactatagggtctgtttctggccttgattccatctgcaaaaacagaggagatttgcaatgggaatcaagaacctggcggcagcgcaaaagatg

SEQ ID NO: 241546 - DNA, 103 bp, Artificial Sequence
  Synthetic Polynucleotide
taatacgactcactatagggagttctgatttctgtttctggccttgattcaacagaggagagaatcaatgccagaaacaaacctggcggcagcgcaaaagatg

SEQ ID NO: 241547 - DNA, 103 bp, Artificial Sequence
  Synthetic Polynucleotide
taatacgactcactatagggggaaccaggtagttctgatttctgtttctgaacagaggagacagaaaatgaaatcagaaaacctggcggcagcgcaaaagatg

SEQ ID NO: 241548 - DNA, 103 bp, Artificial Sequence
  Synthetic Polynucleotide
taatacgactcactatagggtacaggactgggaaccaggtagttctgattaacagaggagaaatcagatgtacctggttaacctggcggcagcgcaaaagatg

SEQ ID NO: 241549 - DNA, 103 bp, Artificial Sequence
  Synthetic Polynucleotide
taatacgactcactataggggaattctaagtacaggactgggaaccaggtaacagaggagaacctggatgccagtcctgaacctggcggcagcgcaaaagatg

SEQ ID NO: 241550 - DNA, 103 bp, Artificial Sequence
  Synthetic Polynucleotide
taatacgactcactataggggtgtggtctagaattctaagtacaggactgaacagaggagacagtccatgacttagaataacctggcggcagcgcaaaagatg

SEQ ID NO: 241551 - DNA, 103 bp, Artificial Sequence
  Synthetic Polynucleotide
taatacgactcactatagggagaaaaggcagtgtggtctagaattctaagaacagaggagacttagaatgctagaccacaacctggcggcagcgcaaaagatg

SEQ ID NO: 241552 - DNA, 103 bp, Artificial Sequence
  Synthetic Polynucleotide
taatacgactcactatagggatttttctgtagaaaaggcagtgtggtctaaacagaggagatagaccatgctgccttttaacctggcggcagcgcaaaagatg

SEQ ID NO: 241553 - DNA, 103 bp, Artificial Sequence
  Synthetic Polynucleotide
taatacgactcactatagggcgagaagggtgtagagtcttcctttttcttaacagaggagaaagaaaatggaagactctaacctggcggcagcgcaaaagatg

SEQ ID NO: 241554 - DNA, 103 bp, Artificial Sequence
  Synthetic Polynucleotide
taatacgactcactatagggatatcagcagatttttctgtagaaaaggcaaacagaggagatgccttatgtacagaaaaaacctggcggcagcgcaaaagatg

SEQ ID NO: 241555 - DNA, 103 bp, Artificial Sequence
  Synthetic Polynucleotide
taatacgactcactatagggacaaattacaatatcagcagatttttctgtaacagaggagaacagaaatgtctgctgataacctggcggcagcgcaaaagatg

SEQ ID NO: 241556 - DNA, 103 bp, Artificial Sequence
  Synthetic Polynucleotide
taatacgactcactatagggactcttcatcacaaattacaatatcagcagaacagaggagactgctgatgttgtaatttaacctggcggcagcgcaaaagatg

SEQ ID NO: 241557 - DNA, 103 bp, Artificial Sequence
  Synthetic Polynucleotide
taatacgactcactatagggggtgagtcacactcttcatcacaaattacaaacagaggagatgtaatatgtgatgaagaaacctggcggcagcgcaaaagatg

SEQ ID NO: 241558 - DNA, 103 bp, Artificial Sequence
  Synthetic Polynucleotide
taatacgactcactataggggactgattcaggtgagtcacactcttcatcaacagaggagagatgaaatgtgtgactcaaacctggcggcagcgcaaaagatg

SEQ ID NO: 241559 - DNA, 103 bp, Artificial Sequence
  Synthetic Polynucleotide
taatacgactcactatagggtttgctggttgactgattcaggtgagtcacaacagaggagagtgactatgctgaatcagaacctggcggcagcgcaaaagatg

SEQ ID NO: 241560 - DNA, 103 bp, Artificial Sequence
  Synthetic Polynucleotide
taatacgactcactatagggtcctcttgggtttgctggttgactgattcaaacagaggagatgaatcatgcaaccagcaaacctggcggcagcgcaaaagatg

SEQ ID NO: 241561 - DNA, 103 bp, Artificial Sequence
  Synthetic Polynucleotide
taatacgactcactatagggtataggactctcctcttgggtttgctggttaacagaggagaaaccagatgacccaagagaacctggcggcagcgcaaaagatg

SEQ ID NO: 241562 - DNA, 103 bp, Artificial Sequence
  Synthetic Polynucleotide
taatacgactcactatagggtgtgaacttctataggactctcctcttgggaacagaggagacccaagatgagagtcctaaacctggcggcagcgcaaaagatg

SEQ ID NO: 241563 - DNA, 103 bp, Artificial Sequence
  Synthetic Polynucleotide
taatacgactcactatagggtcttcagcagtgtgaacttctataggactcaacagaggagagagtccatgagaagttcaaacctggcggcagcgcaaaagatg

SEQ ID NO: 241564 - DNA, 103 bp, Artificial Sequence
  Synthetic Polynucleotide
taatacgactcactatagggatctgaataacgagaagggtgtagagtcttaacagaggagaaagactatgcacccttctaacctggcggcagcgcaaaagatg

SEQ ID NO: 241565 - DNA, 103 bp, Artificial Sequence
  Synthetic Polynucleotide
taatacgactcactatagggaattggaacatcttcagcagtgtgaacttcaacagaggagagaagttatgactgctgaaaacctggcggcagcgcaaaagatg

SEQ ID NO: 241566 - DNA, 103 bp, Artificial Sequence
  Synthetic Polynucleotide
taatacgactcactatagggcttctacagcaattggaacatcttcagcagaacagaggagactgctgatgatgttccaaaacctggcggcagcgcaaaagatg

SEQ ID NO: 241567 - DNA, 103 bp, Artificial Sequence
  Synthetic Polynucleotide
taatacgactcactatagggatcgcatgcacttctacagcaattggaacaaacagaggagatgttccatgtgctgtagaaacctggcggcagcgcaaaagatg

SEQ ID NO: 241568 - DNA, 103 bp, Artificial Sequence
  Synthetic Polynucleotide
taatacgactcactatagggatcctcagaaatcgcatgcacttctacagcaacagaggagagctgtaatggtgcatgcgaacctggcggcagcgcaaaagatg

SEQ ID NO: 241569 - DNA, 103 bp, Artificial Sequence
  Synthetic Polynucleotide
taatacgactcactatagggctatatcataatcctcagaaatcgcatgcaaacagaggagatgcatgatgtttctgaggaacctggcggcagcgcaaaagatg

SEQ ID NO: 241570 - DNA, 103 bp, Artificial Sequence
  Synthetic Polynucleotide
taatacgactcactatagggttttctgtctctatatcataatcctcagaaaacagaggagattctgaatgttatgatataacctggcggcagcgcaaaagatg

SEQ ID NO: 241571 - DNA, 103 bp, Artificial Sequence
  Synthetic Polynucleotide
taatacgactcactatagggagaggaattgttttctgtctctatatcataaacagaggagatatgatatggagacagaaaacctggcggcagcgcaaaagatg

SEQ ID NO: 241572 - DNA, 103 bp, Artificial Sequence
  Synthetic Polynucleotide
taatacgactcactatagggggagactctcagaggaattgttttctgtctaacagaggagaagacagatgacaattcctaacctggcggcagcgcaaaagatg

SEQ ID NO: 241573 - DNA, 103 bp, Artificial Sequence
  Synthetic Polynucleotide
taatacgactcactataggggtttggtcttggagactctcagaggaattgaacagaggagacaattcatgtgagagtctaacctggcggcagcgcaaaagatg

SEQ ID NO: 241574 - DNA, 103 bp, Artificial Sequence
  Synthetic Polynucleotide
taatacgactcactatagggttcttcatcagtttggtcttggagactctcaacagaggagagagagtatgcaagaccaaaacctggcggcagcgcaaaagatg

SEQ ID NO: 241575 - DNA, 103 bp, Artificial Sequence
  Synthetic Polynucleotide
taatacgactcactatagggttccagaggaatctgaataacgagaagggtaacagaggagaacccttatggttattcagaacctggcggcagcgcaaaagatg

SEQ ID NO: 241576 - DNA, 103 bp, Artificial Sequence
  Synthetic Polynucleotide
taatacgactcactatagggtagctggcggttcttcatcagtttggtcttaacagaggagaaagaccatgctgatgaagaacctggcggcagcgcaaaagatg

SEQ ID NO: 241577 - DNA, 103 bp, Artificial Sequence
  Synthetic Polynucleotide
taatacgactcactatagggttacaaagtttagctggcggttcttcatcaaacagaggagatgatgaatgaccgccagcaacctggcggcagcgcaaaagatg

SEQ ID NO: 241578 - DNA, 103 bp, Artificial Sequence
  Synthetic Polynucleotide
taatacgactcactataggggtcaagaattttacaaagtttagctggcggaacagaggagaccgccaatgaaactttgtaacctggcggcagcgcaaaagatg

SEQ ID NO: 241579 - DNA, 103 bp, Artificial Sequence
  Synthetic Polynucleotide
taatacgactcactatagggcttggctcttgtcaagaattttacaaagttaacagaggagaaactttatgaaattcttgaacctggcggcagcgcaaaagatg

SEQ ID NO: 241580 - DNA, 103 bp, Artificial Sequence
  Synthetic Polynucleotide
taatacgactcactatagggacattcaaagcttggctcttgtcaagaattaacagaggagaaattctatgcaagagccaaacctggcggcagcgcaaaagatg

SEQ ID NO: 241581 - DNA, 103 bp, Artificial Sequence
  Synthetic Polynucleotide
taatacgactcactatagggctgggcagtcacattcaaagcttggctcttaacagaggagaaagagcatggctttgaataacctggcggcagcgcaaaagatg

SEQ ID NO: 241582 - DNA, 103 bp, Artificial Sequence
  Synthetic Polynucleotide
taatacgactcactataggggccatttctgctgggcagtcacattcaaagaacagaggagactttgaatgtgactgcccaacctggcggcagcgcaaaagatg

SEQ ID NO: 241583 - DNA, 103 bp, Artificial Sequence
  Synthetic Polynucleotide
taatacgactcactatagggctcagtaaaggccatttctgctgggcagtcaacagaggagagactgcatggcagaaatgaacctggcggcagcgcaaaagatg

SEQ ID NO: 241584 - DNA, 103 bp, Artificial Sequence
  Synthetic Polynucleotide
taatacgactcactataggggctattagctctcagtaaaggccatttctgaacagaggagacagaaaatgcctttactgaacctggcggcagcgcaaaagatg

SEQ ID NO: 241585 - DNA, 103 bp, Artificial Sequence
  Synthetic Polynucleotide
taatacgactcactatagggagaggccactgctattagctctcagtaaagaacagaggagactttacatggagctaataaacctggcggcagcgcaaaagatg

SEQ ID NO: 241586 - DNA, 103 bp, Artificial Sequence
  Synthetic Polynucleotide
taatacgactcactatagggattctgcttattccagaggaatctgaataaaacagaggagattattcatgttcctctggaacctggcggcagcgcaaaagatg

SEQ ID NO: 241587 - DNA, 103 bp, Artificial Sequence
  Synthetic Polynucleotide
taatacgactcactatagggtcacatttatagaggccactgctattagctaacagaggagaagctaaatgcagtggcctaacctggcggcagcgcaaaagatg

SEQ ID NO: 241588 - DNA, 103 bp, Artificial Sequence
  Synthetic Polynucleotide
taatacgactcactatagggctcacaaagttcacatttatagaggccactaacagaggagaagtggcatgtataaatgtaacctggcggcagcgcaaaagatg

SEQ ID NO: 241589 - DNA, 103 bp, Artificial Sequence
  Synthetic Polynucleotide
taatacgactcactatagggtgctgttaaactcacaaagttcacatttataacagaggagaataaatatgaactttgtgaacctggcggcagcgcaaaagatg

SEQ ID NO: 241590 - DNA, 103 bp, Artificial Sequence
  Synthetic Polynucleotide
taatacgactcactataggggaaaaatatttgctgttaaactcacaaagtaacagaggagaactttgatggtttaacagaacctggcggcagcgcaaaagatg

SEQ ID NO: 241591 - DNA, 103 bp, Artificial Sequence
  Synthetic Polynucleotide
taatacgactcactatagggctttaagtcagaaaaatatttgctgttaaaaacagaggagatttaacatgaaatattttaacctggcggcagcgcaaaagatg

SEQ ID NO: 241592 - DNA, 103 bp, Artificial Sequence
  Synthetic Polynucleotide
taatacgactcactatagggtcatatgctgctttaagtcagaaaaatattaacagaggagaaatattatgctgacttaaaacctggcggcagcgcaaaagatg

SEQ ID NO: 241593 - DNA, 103 bp, Artificial Sequence
  Synthetic Polynucleotide
taatacgactcactatagggtgcttcaggatcatatgctgctttaagtcaaacagaggagatgacttatggcagcatataacctggcggcagcgcaaaagatg

SEQ ID NO: 241594 - DNA, 103 bp, Artificial Sequence
  Synthetic Polynucleotide
taatacgactcactatagggagtacgtttatgcttcaggatcatatgctgaacagaggagacagcatatgatcctgaagaacctggcggcagcgcaaaagatg

SEQ ID NO: 241595 - DNA, 103 bp, Artificial Sequence
  Synthetic Polynucleotide
taatacgactcactatagggcatttgaatcagtacgtttatgcttcaggaaacagaggagatcctgaatgataaacgtaaacctggcggcagcgcaaaagatg

SEQ ID NO: 241596 - DNA, 103 bp, Artificial Sequence
  Synthetic Polynucleotide
taatacgactcactatagggactcgacacacatttgaatcagtacgtttaaacagaggagataaacgatgtgattcaaaaacctggcggcagcgcaaaagatg

SEQ ID NO: 241597 - DNA, 103 bp, Artificial Sequence
  Synthetic Polynucleotide
taatacgactcactatagggtccatctgcaattctgcttattccagaggaaacagaggagatcctctatgataagcagaaacctggcggcagcgcaaaagatg

SEQ ID NO: 241598 - DNA, 103 bp, Artificial Sequence
  Synthetic Polynucleotide
taatacgactcactatagggttccttgcatactcgacacacatttgaatcaacagaggagagattcaatggtgtgtcgaaacctggcggcagcgcaaaagatg

SEQ ID NO: 241599 - DNA, 103 bp, Artificial Sequence
  Synthetic Polynucleotide
taatacgactcactatagggtagagaaactttccttgcatactcgacacaaacagaggagatgtgtcatgtatgcaaggaacctggcggcagcgcaaaagatg

SEQ ID NO: 241600 - DNA, 103 bp, Artificial Sequence
  Synthetic Polynucleotide
taatacgactcactatagggagcatattggtagagaaactttccttgcataacagaggagaatgcaaatgaagtttctcaacctggcggcagcgcaaaagatg

SEQ ID NO: 241601 - DNA, 103 bp, Artificial Sequence
  Synthetic Polynucleotide
taatacgactcactatagggttctatcagaagcatattggtagagaaactaacagaggagaagtttcatgaccaatatgaacctggcggcagcgcaaaagatg

SEQ ID NO: 241602 - DNA, 103 bp, Artificial Sequence
  Synthetic Polynucleotide
taatacgactcactataggggtttggcatgttctatcagaagcatattggaacagaggagaccaataatgttctgatagaacctggcggcagcgcaaaagatg

SEQ ID NO: 241603 - DNA, 103 bp, Artificial Sequence
  Synthetic Polynucleotide
taatacgactcactatagggtcttcatgcagtttggcatgttctatcagaaacagaggagatctgatatgacatgccaaaacctggcggcagcgcaaaagatg

SEQ ID NO: 241604 - DNA, 103 bp, Artificial Sequence
  Synthetic Polynucleotide
taatacgactcactataggggtagggatcctcttcatgcagtttggcatgaacagaggagacatgccatgctgcatgaaaacctggcggcagcgcaaaagatg

SEQ ID NO: 241605 - DNA, 103 bp, Artificial Sequence
  Synthetic Polynucleotide
taatacgactcactatagggatttacaaatgtagggatcctcttcatgcaaacagaggagatgcatgatgaggatccctaacctggcggcagcgcaaaagatg

SEQ ID NO: 241606 - DNA, 103 bp, Artificial Sequence
  Synthetic Polynucleotide
taatacgactcactatagggtaatcacagtatttacaaatgtagggatccaacagaggagaggatccatgcatttgtaaaacctggcggcagcgcaaaagatg

SEQ ID NO: 241607 - DNA, 103 bp, Artificial Sequence
  Synthetic Polynucleotide
taatacgactcactatagggtactgtcttataatcacagtatttacaaataacagaggagaatttgtatgtactgtgataacctggcggcagcgcaaaagatg

SEQ ID NO: 241608 - DNA, 103 bp, Artificial Sequence
  Synthetic Polynucleotide
taatacgactcactatagggttccattgaatccatctgcaattctgcttaaacagaggagataagcaatgttgcagatgaacctggcggcagcgcaaaagatg

SEQ ID NO: 241609 - DNA, 103 bp, Artificial Sequence
  Synthetic Polynucleotide
taatacgactcactatagggtctcaaaaattactgtcttataatcacagtaacagaggagaactgtgatgataagacagaacctggcggcagcgcaaaagatg

SEQ ID NO: 241610 - DNA, 103 bp, Artificial Sequence
  Synthetic Polynucleotide
taatacgactcactatagggtggctgaggttctcaaaaattactgtcttaaacagaggagataagacatgaatttttgaaacctggcggcagcgcaaaagatg

SEQ ID NO: 241611 - DNA, 103 bp, Artificial Sequence
  Synthetic Polynucleotide
taatacgactcactatagggtgcaatgtgctggctgaggttctcaaaaataacagaggagaatttttatgaacctcagcaacctggcggcagcgcaaaagatg

SEQ ID NO: 241612 - DNA, 103 bp, Artificial Sequence
  Synthetic Polynucleotide
taatacgactcactatagggaatgggtgtctgcaatgtgctggctgaggtaacagaggagaacctcaatgagcacattgaacctggcggcagcgcaaaagatg

SEQ ID NO: 241613 - DNA, 103 bp, Artificial Sequence
  Synthetic Polynucleotide
taatacgactcactatagggtgatcactaaaatgggtgtctgcaatgtgcaacagaggagagcacatatgagacacccaaacctggcggcagcgcaaaagatg

SEQ ID NO: 241614 - DNA, 103 bp, Artificial Sequence
  Synthetic Polynucleotide
taatacgactcactatagggccaatagaggtgatcactaaaatgggtgtcaacagaggagagacaccatgtttagtgataacctggcggcagcgcaaaagatg

SEQ ID NO: 241615 - DNA, 103 bp, Artificial Sequence
  Synthetic Polynucleotide
taatacgactcactatagggactgttcacaccaatagaggtgatcactaaaacagaggagattagtgatgacctctattaacctggcggcagcgcaaaagatg

SEQ ID NO: 241616 - DNA, 103 bp, Artificial Sequence
  Synthetic Polynucleotide
taatacgactcactatagggtgtacatcacactgttcacaccaatagaggaacagaggagacctctaatggtgtgaacaaacctggcggcagcgcaaaagatg

SEQ ID NO: 241617 - DNA, 103 bp, Artificial Sequence
  Synthetic Polynucleotide
taatacgactcactatagggtgaggagaactgtacatcacactgttcacaaacagaggagatgtgaaatgtgtgatgtaaacctggcggcagcgcaaaagatg

SEQ ID NO: 241618 - DNA, 103 bp, Artificial Sequence
  Synthetic Polynucleotide
taatacgactcactataggggttcactgcttgaggagaactgtacatcacaacagaggagagtgatgatgagttctcctaacctggcggcagcgcaaaagatg

SEQ ID NO: 241619 - DNA, 103 bp, Artificial Sequence
  Synthetic Polynucleotide
taatacgactcactatagggtcagagaaaattccattgaatccatctgcaaacagaggagatgcagaatgattcaatggaacctggcggcagcgcaaaagatg

SEQ ID NO: 241620 - DNA, 103 bp, Artificial Sequence
  Synthetic Polynucleotide
taatacgactcactatagggtgtaggtagagttcactgcttgaggagaacaacagaggagagttctcatgaagcagtgaaacctggcggcagcgcaaaagatg

SEQ ID NO: 241621 - DNA, 103 bp, Artificial Sequence
  Synthetic Polynucleotide
taatacgactcactatagggctcctggaaatgtaggtagagttcactgctaacagaggagaagcagtatgctctacctaaacctggcggcagcgcaaaagatg

SEQ ID NO: 241622 - DNA, 103 bp, Artificial Sequence
  Synthetic Polynucleotide
taatacgactcactatagggcacagctgtgctcctggaaatgtaggtagaaacagaggagatctaccatgatttccaggaacctggcggcagcgcaaaagatg

SEQ ID NO: 241623 - DNA, 103 bp, Artificial Sequence
  Synthetic Polynucleotide
taatacgactcactatagggtactgttcatcacagctgtgctcctggaaaaacagaggagatttccaatggcacagctgaacctggcggcagcgcaaaagatg

SEQ ID NO: 241624 - DNA, 103 bp, Artificial Sequence
  Synthetic Polynucleotide
taatacgactcactatagggctgacacaagtactgttcatcacagctgtgaacagaggagacacagcatggatgaacagaacctggcggcagcgcaaaagatg

SEQ ID NO: 241625 - DNA, 103 bp, Artificial Sequence
  Synthetic Polynucleotide
taatacgactcactataggggttcacagaactgacacaagtactgttcataacagaggagaatgaacatgacttgtgtcaacctggcggcagcgcaaaagatg

SEQ ID NO: 241626 - DNA, 103 bp, Artificial Sequence
  Synthetic Polynucleotide
taatacgactcactatagggttagtttcatgttcacagaactgacacaagaacagaggagacttgtgatggttctgtgaaacctggcggcagcgcaaaagatg

SEQ ID NO: 241627 - DNA, 103 bp, Artificial Sequence
  Synthetic Polynucleotide
taatacgactcactatagggttctggatcattagtttcatgttcacagaaaacagaggagattctgtatgcatgaaactaacctggcggcagcgcaaaagatg

SEQ ID NO: 241628 - DNA, 103 bp, Artificial Sequence
  Synthetic Polynucleotide
taatacgactcactatagggtatgcaagtcttctggatcattagtttcataacagaggagaatgaaaatgatgatccagaacctggcggcagcgcaaaagatg

SEQ ID NO: 241629 - DNA, 103 bp, Artificial Sequence
  Synthetic Polynucleotide
taatacgactcactatagggaccacatggctatgcaagtcttctggatcaaacagaggagatgatccatgagacttgcaaacctggcggcagcgcaaaagatg

SEQ ID NO: 241630 - DNA, 103 bp, Artificial Sequence
  Synthetic Polynucleotide
taatacgactcactatagggcagggtcagtgattcctgggcctttgtcataacagaggagaatgacaatggcccaggaaaacctggcggcagcgcaaaagatg

SEQ ID NO: 241631 - DNA, 103 bp, Artificial Sequence; identical to SEQ ID NO: 238641
  Synthetic Polynucleotide

SEQ ID NO: 241632 - DNA, 103 bp, Artificial Sequence
  Synthetic Polynucleotide
taatacgactcactataggggtgagttcgttgatgtatgttgagattgccaacagaggagaggcaatatgaacatacataacctggcggcagcgcaaaagatg

SEQ ID NO: 241633 - DNA, 103 bp, Artificial Sequence
  Synthetic Polynucleotide
taatacgactcactatagggtctctccagtgtgagttcgttgatgtatgtaacagaggagaacatacatgaacgaactcaacctggcggcagcgcaaaagatg

SEQ ID NO: 241634 - DNA, 103 bp, Artificial Sequence
  Synthetic Polynucleotide
taatacgactcactatagggccataaggtttctctccagtgtgagttcgtaacagaggagaacgaacatgcactggagaaacctggcggcagcgcaaaagatg

SEQ ID NO: 241635 - DNA, 103 bp, Artificial Sequence
  Synthetic Polynucleotide
taatacgactcactataggggtcaatgcatccataaggtttctctccagtaacagaggagaactggaatgaaaccttataacctggcggcagcgcaaaagatg

SEQ ID NO: 241636 - DNA, 103 bp, Artificial Sequence
  Synthetic Polynucleotide
taatacgactcactatagggccttgccacagtcaatgcatccataaggttaacagaggagaaaccttatggatgcattgaacctggcggcagcgcaaaagatg

SEQ ID NO: 241637 - DNA, 103 bp, Artificial Sequence
  Synthetic Polynucleotide
taatacgactcactatagggtggctgaaggccttgccacagtcaatgcataacagaggagaatgcatatgctgtggcaaaacctggcggcagcgcaaaagatg

SEQ ID NO: 241638 - DNA, 103 bp, Artificial Sequence
  Synthetic Polynucleotide
taatacgactcactataggggcaagacttctggctgaaggccttgccacaaacagaggagatgtggcatggccttcagcaacctggcggcagcgcaaaagatg

SEQ ID NO: 241639 - DNA, 103 bp, Artificial Sequence
  Synthetic Polynucleotide
taatacgactcactataggggtgctacaaggcaagacttctggctgaaggaacagaggagaccttcaatgagaagtcttaacctggcggcagcgcaaaagatg

SEQ ID NO: 241640 - DNA, 103 bp, Artificial Sequence
  Synthetic Polynucleotide
taatacgactcactatagggtatctctgatgtgctacaaggcaagacttcaacagaggagagaagtcatgccttgtagcaacctggcggcagcgcaaaagatg

SEQ ID NO: 241641 - DNA, 103 bp, Artificial Sequence
  Synthetic Polynucleotide
taatacgactcactatagggtcctgtatgatatctctgatgtgctacaagaacagaggagacttgtaatgcatcagagaaacctggcggcagcgcaaaagatg

SEQ ID NO: 241642 - DNA, 103 bp, Artificial Sequence; identical to SEQ ID NO: 238652
  Synthetic Polynucleotide

SEQ ID NO: 241643 - DNA, 103 bp, Artificial Sequence
  Synthetic Polynucleotide
taatacgactcactatagggagggagtctttcctgtatgatatctctgataacagaggagaatcagaatgatcatacagaacctggcggcagcgcaaaagatg

SEQ ID NO: 241644 - DNA, 103 bp, Artificial Sequence
  Synthetic Polynucleotide
taatacgactcactatagggggacatacaaagggagtctttcctgtatgaaacagaggagatcatacatgaaagactccaacctggcggcagcgcaaaagatg

SEQ ID NO: 241645 - DNA, 103 bp, Artificial Sequence
  Synthetic Polynucleotide
taatacgactcactatagggcccacattcaggacatacaaagggagtcttaacagaggagaaagactatgtttgtatgtaacctggcggcagcgcaaaagatg

SEQ ID NO: 241646 - DNA, 103 bp, Artificial Sequence
  Synthetic Polynucleotide
taatacgactcactatagggaacagggttgcccacattcaggacatacaaaacagaggagattgtatatgctgaatgtgaacctggcggcagcgcaaaagatg

SEQ ID NO: 241647 - DNA, 103 bp, Artificial Sequence
  Synthetic Polynucleotide
taatacgactcactataggggacttctgtgaacagggttgcccacattcaaacagaggagatgaatgatggcaaccctgaacctggcggcagcgcaaaagatg

SEQ ID NO: 241648 - DNA, 103 bp, Artificial Sequence
  Synthetic Polynucleotide
taatacgactcactatagggaatgagtcctgacttctgtgaacagggttgaacagaggagacaacccatgtcacagaagaacctggcggcagcgcaaaagatg

SEQ ID NO: 241649 - DNA, 103 bp, Artificial Sequence
  Synthetic Polynucleotide
taatacgactcactatagggtctgatgtctaatgagtcctgacttctgtgaacagaggagacacagaatgcaggactcaaacctggcggcagcgcaaaagatg

SEQ ID NO: 241650 - DNA, 103 bp, Artificial Sequence
  Synthetic Polynucleotide
taatacgactcactataggggagtgaattttctgatgtctaatgagtcctaacagaggagaaggactatgtagacatcaaacctggcggcagcgcaaaagatg

SEQ ID NO: 241651 - DNA, 103 bp, Artificial Sequence
  Synthetic Polynucleotide
taatacgactcactatagggtttctctcctgagtgaattttctgatgtctaacagaggagaagacatatgaaaattcacaacctggcggcagcgcaaaagatg

SEQ ID NO: 241652 - DNA, 103 bp, Artificial Sequence
  Synthetic Polynucleotide
taatacgactcactatagggatttatagggtttctctcctgagtgaatttaacagaggagaaaattcatgcaggagagaaacctggcggcagcgcaaaagatg

SEQ ID NO: 241653 - DNA, 103 bp, Artificial Sequence
  Synthetic Polynucleotide
taatacgactcactatagggactgacacaaggttgctgtagttctccaacaacagaggagagttggaatgctacagcaaaacctggcggcagcgcaaaagatg

SEQ ID NO: 241654 - DNA, 103 bp, Artificial Sequence
  Synthetic Polynucleotide
taatacgactcactatagggcagtcactgcatttatagggtttctctcctaacagaggagaaggagaatgaccctataaaacctggcggcagcgcaaaagatg

SEQ ID NO: 241655 - DNA, 103 bp, Artificial Sequence
  Synthetic Polynucleotide
taatacgactcactatagggggctttcccacagtcactgcatttatagggaacagaggagaccctatatgtgcagtgacaacctggcggcagcgcaaaagatg

SEQ ID NO: 241656 - DNA, 103 bp, Artificial Sequence
  Synthetic Polynucleotide
taatacgactcactatagggttgtaaggaaggctttcccacagtcactgcaacagaggagagcagtgatggtgggaaagaacctggcggcagcgcaaaagatg

SEQ ID NO: 241657 - DNA, 103 bp, Artificial Sequence
  Synthetic Polynucleotide
taatacgactcactatagggagcattgtctttgtaaggaaggctttcccaaacagaggagatgggaaatgcttccttacaacctggcggcagcgcaaaagatg

SEQ ID NO: 241658 - DNA, 103 bp, Artificial Sequence
  Synthetic Polynucleotide
taatacgactcactatagggatgtacaatgagcattgtctttgtaaggaaaacagaggagattccttatgaagacaatgaacctggcggcagcgcaaaagatg

SEQ ID NO: 241659 - DNA, 103 bp, Artificial Sequence
  Synthetic Polynucleotide
taatacgactcactataggggagttctgtgatgtacaatgagcattgtctaacagaggagaagacaaatgtcattgtacaacctggcggcagcgcaaaagatg

SEQ ID NO: 241660 - DNA, 103 bp, Artificial Sequence
  Synthetic Polynucleotide
taatacgactcactatagggtctcccgtgtgagttctgtgatgtacaatgaacagaggagacattgtatgtcacagaacaacctggcggcagcgcaaaagatg

SEQ ID NO: 241661 - DNA, 103 bp, Artificial Sequence
  Synthetic Polynucleotide
taatacgactcactatagggatagggtctctctcccgtgtgagttctgtgaacagaggagacacagaatgcacacgggaaacctggcggcagcgcaaaagatg

SEQ ID NO: 241662 - DNA, 103 bp, Artificial Sequence
  Synthetic Polynucleotide
taatacgactcactatagggcatcacagccatagggtctctctcccgtgtaacagaggagaacacggatgagagaccctaacctggcggcagcgcaaaagatg

SEQ ID NO: 241663 - DNA, 103 bp, Artificial Sequence
  Synthetic Polynucleotide
taatacgactcactatagggttctcacactcatcacagccatagggtctcaacagaggagagagaccatgtggctgtgaaacctggcggcagcgcaaaagatg

SEQ ID NO: 241664 - DNA, 103 bp, Artificial Sequence
  Synthetic Polynucleotide
taatacgactcactatagggttgataccccactgacacaaggttgctgtaaacagaggagatacagcatgcttgtgtcaaacctggcggcagcgcaaaagatg

SEQ ID NO: 241665 - DNA, 103 bp, Artificial Sequence
  Synthetic Polynucleotide
taatacgactcactataggggaagtaagctttctcacactcatcacagccaacagaggagaggctgtatggagtgtgagaacctggcggcagcgcaaaagatg

SEQ ID NO: 241666 - DNA, 103 bp, Artificial Sequence
  Synthetic Polynucleotide
taatacgactcactatagggaagacatatagaagtaagctttctcacactaacagaggagaagtgtgatgaagcttactaacctggcggcagcgcaaaagatg

SEQ ID NO: 241667 - DNA, 103 bp, Artificial Sequence
  Synthetic Polynucleotide
taatacgactcactatagggttaacaaggcaagacatatagaagtaagctaacagaggagaagcttaatgctatatgtcaacctggcggcagcgcaaaagatg

SEQ ID NO: 241668 - DNA, 103 bp, Artificial Sequence
  Synthetic Polynucleotide
taatacgactcactatagggtctcttatgtttaacaaggcaagacatataaacagaggagatatatgatgtgccttgttaacctggcggcagcgcaaaagatg

SEQ ID NO: 241669 - DNA, 103 bp, Artificial Sequence
  Synthetic Polynucleotide
taatacgactcactatagggttgagtgtattctcttatgtttaacaaggcaacagaggagagccttgatgaacataagaaacctggcggcagcgcaaaagatg

SEQ ID NO: 241670 - DNA, 103 bp, Artificial Sequence
  Synthetic Polynucleotide
taatacgactcactatagggcgtttctcccttgagtgtattctcttatgtaacagaggagaacataaatgaatacactcaacctggcggcagcgcaaaagatg

SEQ ID NO: 241671 - DNA, 103 bp, Artificial Sequence
  Synthetic Polynucleotide
taatacgactcactatagggtgaatccccccgtttctcccttgagtgtataacagaggagaatacacatgagggagaaaaacctggcggcagcgcaaaagatg

SEQ ID NO: 241672 - DNA, 103 bp, Artificial Sequence
  Synthetic Polynucleotide
taatacgactcactatagggccaccttcactgaatccccccgtttctcccaacagaggagagggagaatgggggggattaacctggcggcagcgcaaaagatg

SEQ ID NO: 241673 - DNA, 103 bp, Artificial Sequence
  Synthetic Polynucleotide
taatacgactcactataggggaaggattttccaccttcactgaatcccccaacagaggagagggggaatgagtgaaggtaacctggcggcagcgcaaaagatg

SEQ ID NO: 241674 - DNA, 103 bp, Artificial Sequence
  Synthetic Polynucleotide
taatacgactcactatagggacttgctgtggaaggattttccaccttcacaacagaggagagtgaagatggaaaatcctaacctggcggcagcgcaaaagatg

SEQ ID NO: 241675 - DNA, 103 bp, Artificial Sequence
  Synthetic Polynucleotide
taatacgactcactataggggtttgccggcttgataccccactgacacaaaacagaggagattgtgtatgtggggtatcaacctggcggcagcgcaaaagatg

SEQ ID NO: 241676 - DNA, 103 bp, Artificial Sequence
  Synthetic Polynucleotide
taatacgactcactatagggttaagctgtgacttgctgtggaaggattttaacagaggagaaaaatcatgccacagcaaaacctggcggcagcgcaaaagatg

SEQ ID NO: 241677 - DNA, 103 bp, Artificial Sequence
  Synthetic Polynucleotide
taatacgactcactatagggtcactaggacttaagctgtgacttgctgtgaacagaggagacacagcatgtcacagcttaacctggcggcagcgcaaaagatg

SEQ ID NO: 241678 - DNA, 103 bp, Artificial Sequence
  Synthetic Polynucleotide
taatacgactcactatagggctgcacatgttcactaggacttaagctgtgaacagaggagacacagcatgagtcctagtaacctggcggcagcgcaaaagatg

SEQ ID NO: 241679 - DNA, 103 bp, Artificial Sequence
  Synthetic Polynucleotide
taatacgactcactatagggggcttttcccctgcacatgttcactaggacaacagaggagagtcctaatgaacatgtgcaacctggcggcagcgcaaaagatg

SEQ ID NO: 241680 - DNA, 103 bp, Artificial Sequence
  Synthetic Polynucleotide
taatacgactcactatagggatattaacagggcttttcccctgcacatgtaacagaggagaacatgtatgggggaaaagaacctggcggcagcgcaaaagatg

SEQ ID NO: 241681 - DNA, 103 bp, Artificial Sequence
  Synthetic Polynucleotide
taatacgactcactatagggcacagttaccatattaacagggcttttcccaacagaggagagggaaaatgcctgttaataacctggcggcagcgcaaaagatg

SEQ ID NO: 241682 - DNA, 103 bp, Artificial Sequence
  Synthetic Polynucleotide
taatacgactcactatagggccaccattgccacagttaccatattaacagaacagaggagactgttaatgtggtaactgaacctggcggcagcgcaaaagatg

SEQ ID NO: 241683 - DNA, 103 bp, Artificial Sequence
  Synthetic Polynucleotide
taatacgactcactatagggcactgccctgccaccattgccacagttaccaacagaggagaggtaacatgggcaatggtaacctggcggcagcgcaaaagatg

SEQ ID NO: 241684 - DNA, 103 bp, Artificial Sequence
  Synthetic Polynucleotide
taatacgactcactatagggggcaaactcacactgccctgccaccattgcaacagaggagagcaatgatggcagggcagaacctggcggcagcgcaaaagatg

SEQ ID NO: 241685 - DNA, 103 bp, Artificial Sequence
  Synthetic Polynucleotide
taatacgactcactataggggcaggatgtgggcaaactcacactgccctgaacagaggagacagggcatggtgagtttgaacctggcggcagcgcaaaagatg

SEQ ID NO: 241686 - DNA, 103 bp, Artificial Sequence
  Synthetic Polynucleotide
taatacgactcactatagggagggcatcaggtttgccggcttgataccccaacagaggagaggggtaatgagccggcaaaacctggcggcagcgcaaaagatg

SEQ ID NO: 241687 - DNA, 103 bp, Artificial Sequence
  Synthetic Polynucleotide
taatacgactcactatagggcaacttggtgagggcatcaggtttgccggcaacagaggagagccggcatgcctgatgccaacctggcggcagcgcaaaagatg

SEQ ID NO: 241688 - DNA, 103 bp, Artificial Sequence
  Synthetic Polynucleotide
taatacgactcactatagggctccttgttccaacttggtgagggcatcagaacagaggagactgatgatgtcaccaagtaacctggcggcagcgcaaaagatg

SEQ ID NO: 241689 - DNA, 103 bp, Artificial Sequence
  Synthetic Polynucleotide
taatacgactcactatagggcatagtggttctccttgttccaacttggtgaacagaggagacaccaaatgggaacaaggaacctggcggcagcgcaaaagatg

SEQ ID NO: 241690 - DNA, 103 bp, Artificial Sequence
  Synthetic Polynucleotide
taatacgactcactatagggttctagtgtccatagtggttctccttgttcaacagaggagagaacaaatggaaccactaaacctggcggcagcgcaaaagatg

SEQ ID NO: 241691 - DNA, 103 bp, Artificial Sequence; identical to SEQ ID NO: 241399
  Synthetic Polynucleotide

SEQ ID NO: 241692 - DNA, 103 bp, Artificial Sequence
  Synthetic Polynucleotide
taatacgactcactatagggggatttcatcttctagtgtccatagtggttaacagaggagaaaccacatgggacactagaacctggcggcagcgcaaaagatg

SEQ ID NO: 241693 - DNA, 103 bp, Artificial Sequence
  Synthetic Polynucleotide
taatacgactcactataggggctggactgtggatttcatcttctagtgtcaacagaggagagacactatgagatgaaataacctggcggcagcgcaaaagatg

SEQ ID NO: 241694 - DNA, 103 bp, Artificial Sequence
  Synthetic Polynucleotide
taatacgactcactatagggttctgggtgggctggactgtggatttcatcaacagaggagagatgaaatgcacagtccaaacctggcggcagcgcaaaagatg

SEQ ID NO: 241695 - DNA, 103 bp, Artificial Sequence
  Synthetic Polynucleotide
taatacgactcactatagggctttctcaatttctgggtgggctggactgtaacagaggagaacagtcatgcccacccagaacctggcggcagcgcaaaagatg

SEQ ID NO: 241696 - DNA, 103 bp, Artificial Sequence
  Synthetic Polynucleotide
taatacgactcactatagggtgatcatcagctttctcaatttctgggtggaacagaggagaccacccatgaattgagaaaacctggcggcagcgcaaaagatg

SEQ ID NO: 241697 - DNA, 103 bp, Artificial Sequence
  Synthetic Polynucleotide
taatacgactcactatagggctgctgcagatgatcatcagctttctcaataacagaggagaattgagatggctgatgataacctggcggcagcgcaaaagatg

SEQ ID NO: 241698 - DNA, 103 bp, Artificial Sequence
  Synthetic Polynucleotide
taatacgactcactatagggtttgcaagggctgctgcagatgatcatcagaacagaggagactgatgatgatctgcagcaacctggcggcagcgcaaaagatg

SEQ ID NO: 241699 - DNA, 103 bp, Artificial Sequence
  Synthetic Polynucleotide
taatacgactcactatagggattttttggttttgcaagggctgctgcagaaacagaggagatctgcaatggcccttgcaaacctggcggcagcgcaaaagatg

SEQ ID NO: 241700 - DNA, 103 bp, Artificial Sequence
  Synthetic Polynucleotide
taatacgactcactatagggcctcttcagtattttttggttttgcaagggaacagaggagacccttgatgaaccaaaaaaacctggcggcagcgcaaaagatg

SEQ ID NO: 241701 - DNA, 103 bp, Artificial Sequence
  Synthetic Polynucleotide
taatacgactcactataggggttgtcccgtcctcttcagtattttttggtaacagaggagaaccaaaatgtactgaagaaacctggcggcagcgcaaaagatg

SEQ ID NO: 241702 - DNA, 103 bp, Artificial Sequence
  Synthetic Polynucleotide
taatacgactcactatagggaagtccacagccacatcctccagggtcagtaacagaggagaactgacatgggaggatgtaacctggcggcagcgcaaaagatg

SEQ ID NO: 241703 - DNA, 103 bp, Artificial Sequence
  Synthetic Polynucleotide
taatacgactcactatagggtgttcatagcgttgtcccgtcctcttcagtaacagaggagaactgaaatggacgggacaaacctggcggcagcgcaaaagatg

SEQ ID NO: 241704 - DNA, 103 bp, Artificial Sequence
  Synthetic Polynucleotide
taatacgactcactatagggagttcttccgtgttcatagcgttgtcccgtaacagaggagaacgggaatgcgctatgaaaacctggcggcagcgcaaaagatg

SEQ ID NO: 241705 - DNA, 103 bp, Artificial Sequence
  Synthetic Polynucleotide
taatacgactcactatagggatgatttcaaagttcttccgtgttcatagcaacagaggagagctatgatgacggaagaaaacctggcggcagcgcaaaagatg

SEQ ID NO: 241706 - DNA, 103 bp, Artificial Sequence
  Synthetic Polynucleotide
taatacgactcactatagggaaacctaaatatgatttcaaagttcttccgaacagaggagacggaagatgtttgaaatcaacctggcggcagcgcaaaagatg

SEQ ID NO: 241707 - DNA, 103 bp, Artificial Sequence
  Synthetic Polynucleotide
taatacgactcactatagggctggttggttaaacctaaatatgatttcaaaacagaggagattgaaaatgtatttaggtaacctggcggcagcgcaaaagatg

SEQ ID NO: 241708 - DNA, 103 bp, Artificial Sequence
  Synthetic Polynucleotide
taatacgactcactatagggatcttctgctctggttggttaaacctaaataacagaggagaatttagatgtaaccaaccaacctggcggcagcgcaaaagatg

SEQ ID NO: 241709 - DNA, 103 bp, Artificial Sequence
  Synthetic Polynucleotide
taatacgactcactatagggtttctgttgtatcttctgctctggttggttaacagaggagaaaccaaatggagcagaagaacctggcggcagcgcaaaagatg

SEQ ID NO: 241710 - DNA, 103 bp, Artificial Sequence
  Synthetic Polynucleotide
taatacgactcactatagggagcaggctcctttctgttgtatcttctgctaacagaggagaagcagaatgtacaacagaaacctggcggcagcgcaaaagatg

SEQ ID NO: 241711 - DNA, 103 bp, Artificial Sequence
  Synthetic Polynucleotide
taatacgactcactatagggcattaaactcagcaggctcctttctgttgtaacagaggagaacaacaatgaggagcctgaacctggcggcagcgcaaaagatg

SEQ ID NO: 241712 - DNA, 103 bp, Artificial Sequence
  Synthetic Polynucleotide
taatacgactcactataggggctccatctccattaaactcagcaggctccaacagaggagaggagccatgtgagtttaaaacctggcggcagcgcaaaagatg

SEQ ID NO: 241713 - DNA, 103 bp, Artificial Sequence
  Synthetic Polynucleotide
taatacgactcactatagggctcccaggtgaagtccacagccacatcctcaacagaggagagaggatatggctgtggacaacctggcggcagcgcaaaagatg

SEQ ID NO: 241714 - DNA, 103 bp, Artificial Sequence
  Synthetic Polynucleotide
taatacgactcactatagggatggagaaaagctccatctccattaaactcaacagaggagagagtttatgggagatggaaacctggcggcagcgcaaaagatg

SEQ ID NO: 241715 - DNA, 103 bp, Artificial Sequence
  Synthetic Polynucleotide
taatacgactcactatagggcatgattatcatggagaaaagctccatctcaacagaggagagagatgatgcttttctccaacctggcggcagcgcaaaagatg

SEQ ID NO: 241716 - DNA, 103 bp, Artificial Sequence
  Synthetic Polynucleotide
taatacgactcactatagggggcatttgttcatgattatcatggagaaaaaacagaggagattttctatgtgataatcaaacctggcggcagcgcaaaagatg

SEQ ID NO: 241717 - DNA, 103 bp, Artificial Sequence
  Synthetic Polynucleotide
taatacgactcactatagggaatttccgtaggcatttgttcatgattatcaacagaggagagataatatggaacaaatgaacctggcggcagcgcaaaagatg

SEQ ID NO: 241718 - DNA, 103 bp, Artificial Sequence
  Synthetic Polynucleotide
taatacgactcactatagggcagggaattcaatttccgtaggcatttgttaacagaggagaaacaaaatgctacggaaaaacctggcggcagcgcaaaagatg

SEQ ID NO: 241719 - DNA, 103 bp, Artificial Sequence
  Synthetic Polynucleotide
taatacgactcactatagggtttctactttcagggaattcaatttccgtaaacagaggagatacggaatgtgaattcccaacctggcggcagcgcaaaagatg

SEQ ID NO: 241720 - DNA, 103 bp, Artificial Sequence
  Synthetic Polynucleotide
taatacgactcactataggggctgatgggttttctactttcagggaattcaacagaggagagaattcatggaaagtagaaacctggcggcagcgcaaaagatg

SEQ ID NO: 241721 - DNA, 103 bp, Artificial Sequence
  Synthetic Polynucleotide
taatacgactcactataggggtgacttggtgctgatgggttttctactttaacagaggagaaaagtaatgaacccatcaaacctggcggcagcgcaaaagatg

SEQ ID NO: 241722 - DNA, 103 bp, Artificial Sequence
  Synthetic Polynucleotide
taatacgactcactatagggttaaggaattgtgacttggtgctgatgggtaacagaggagaacccatatgcaccaagtcaacctggcggcagcgcaaaagatg

SEQ ID NO: 241723 - DNA, 103 bp, Artificial Sequence
  Synthetic Polynucleotide
taatacgactcactatagggttgctgatgtttaaggaattgtgacttggtaacagaggagaaccaagatgcaattccttaacctggcggcagcgcaaaagatg

SEQ ID NO: 241724 - DNA, 103 bp, Artificial Sequence
  Synthetic Polynucleotide
taatacgactcactatagggactgccactcctcccaggtgaagtccacagaacagaggagactgtggatgtcacctgggaacctggcggcagcgcaaaagatg

SEQ ID NO: 241725 - DNA, 103 bp, Artificial Sequence
  Synthetic Polynucleotide
taatacgactcactatagggtgttgtgtgtttgctgatgtttaaggaattaacagaggagaaattccatgaacatcagcaacctggcggcagcgcaaaagatg

SEQ ID NO: 241726 - DNA, 103 bp, Artificial Sequence
  Synthetic Polynucleotide
taatacgactcactataggggctttctctatgttgtgtgtttgctgatgtaacagaggagaacatcaatgaacacacaaaacctggcggcagcgcaaaagatg

SEQ ID NO: 241727 - DNA, 103 bp, Artificial Sequence
  Synthetic Polynucleotide
taatacgactcactataggggcattcatgggctttctctatgttgtgtgtaacagaggagaacacacatgatagagaaaaacctggcggcagcgcaaaagatg

SEQ ID NO: 241728 - DNA, 103 bp, Artificial Sequence
  Synthetic Polynucleotide
taatacgactcactatagggcacagtcagtgcattcatgggctttctctaaacagaggagatagagaatgcccatgaataacctggcggcagcgcaaaagatg

SEQ ID NO: 241729 - DNA, 103 bp, Artificial Sequence
  Synthetic Polynucleotide
taatacgactcactatagggaaagctttcccacagtcagtgcattcatggaacagaggagaccatgaatgcactgactgaacctggcggcagcgcaaaagatg

SEQ ID NO: 241730 - DNA, 103 bp, Artificial Sequence
  Synthetic Polynucleotide
taatacgactcactatagggcttcttgaggaaagctttcccacagtcagtaacagaggagaactgacatggggaaagctaacctggcggcagcgcaaaagatg

SEQ ID NO: 241731 - DNA, 103 bp, Artificial Sequence
  Synthetic Polynucleotide
taatacgactcactatagggtgagctgagacttcttgaggaaagctttccaacagaggagaggaaagatgtcctcaagaaacctggcggcagcgcaaaagatg

SEQ ID NO: 241732 - DNA, 103 bp, Artificial Sequence
  Synthetic Polynucleotide
taatacgactcactatagggttatgctcagtgagctgagacttcttgaggaacagaggagacctcaaatggtctcagctaacctggcggcagcgcaaaagatg

SEQ ID NO: 241733 - DNA, 103 bp, Artificial Sequence
  Synthetic Polynucleotide
taatacgactcactatagggatgaattctcttatgctcagtgagctgagaaacagaggagatctcagatgactgagcataacctggcggcagcgcaaaagatg

SEQ ID NO: 241734 - DNA, 103 bp, Artificial Sequence
  Synthetic Polynucleotide
taatacgactcactatagggtctttcctgtatgaattctcttatgctcagaacagaggagactgagcatgagagaattcaacctggcggcagcgcaaaagatg

SEQ ID NO: 241735 - DNA, 103 bp, Artificial Sequence
  Synthetic Polynucleotide
taatacgactcactataggggggctcaggaactgccactcctcccaggtgaacagaggagacacctgatgggagtggcaaacctggcggcagcgcaaaagatg

SEQ ID NO: 241736 - DNA, 103 bp, Artificial Sequence
  Synthetic Polynucleotide
taatacgactcactatagggacgtggggtttctttcctgtatgaattctcaacagaggagagagaatatgtacaggaaaaacctggcggcagcgcaaaagatg

SEQ ID NO: 241737 - DNA, 103 bp, Artificial Sequence
  Synthetic Polynucleotide
taatacgactcactatagggcaagctacacacgtggggtttctttcctgtaacagaggagaacaggaatgaaaccccacaacctggcggcagcgcaaaagatg

SEQ ID NO: 241738 - DNA, 103 bp, Artificial Sequence
  Synthetic Polynucleotide
taatacgactcactatagggctttcccacacaagctacacacgtggggttaacagaggagaaaccccatgtgtgtagctaacctggcggcagcgcaaaagatg

SEQ ID NO: 241739 - DNA, 103 bp, Artificial Sequence
  Synthetic Polynucleotide
taatacgactcactatagggttgtagaaggctttcccacacaagctacacaacagaggagagtgtagatggtgtgggaaaacctggcggcagcgcaaaagatg

SEQ ID NO: 241740 - DNA, 103 bp, Artificial Sequence
  Synthetic Polynucleotide
taatacgactcactatagggcctgtacttcttgtagaaggctttcccacaaacagaggagatgtgggatggccttctacaacctggcggcagcgcaaaagatg

SEQ ID NO: 241741 - DNA, 103 bp, Artificial Sequence
  Synthetic Polynucleotide
taatacgactcactataggggttcagtgagcctgtacttcttgtagaaggaacagaggagaccttctatgagaagtacaaacctggcggcagcgcaaaagatg

SEQ ID NO: 241742 - DNA, 103 bp, Artificial Sequence
  Synthetic Polynucleotide
taatacgactcactataggggctctctcgtgttcagtgagcctgtacttcaacagaggagagaagtaatggctcactgaaacctggcggcagcgcaaaagatg

SEQ ID NO: 241743 - DNA, 103 bp, Artificial Sequence
  Synthetic Polynucleotide
taatacgactcactatagggtcctctgtgagctctctcgtgttcagtgagaacagaggagactcactatgcacgagagaaacctggcggcagcgcaaaagatg

SEQ ID NO: 241744 - DNA, 103 bp, Artificial Sequence
  Synthetic Polynucleotide
taatacgactcactatagggggggtttctctcctctgtgagctctctcgtaacagaggagaacgagaatgctcacagagaacctggcggcagcgcaaaagatg

SEQ ID NO: 241745 - DNA, 103 bp, Artificial Sequence
  Synthetic Polynucleotide
taatacgactcactatagggctacacccgtggggtttctctcctctgtgaaacagaggagatcacagatgagagaaaccaacctggcggcagcgcaaaagatg

SEQ ID NO: 241746 - DNA, 103 bp, Artificial Sequence
  Synthetic Polynucleotide
taatacgactcactatagggcttctgagcagggctcaggaactgccactcaacagaggagagagtggatgttcctgagcaacctggcggcagcgcaaaagatg

SEQ ID NO: 241747 - DNA, 103 bp, Artificial Sequence
  Synthetic Polynucleotide
taatacgactcactatagggcccacacaagctacacccgtggggtttctcaacagaggagagagaaaatgcacgggtgtaacctggcggcagcgcaaaagatg

SEQ ID NO: 241748 - DNA, 103 bp, Artificial Sequence
  Synthetic Polynucleotide
taatacgactcactatagggagaaggctttcccacacaagctacacccgtaacagaggagaacgggtatggcttgtgtgaacctggcggcagcgcaaaagatg

SEQ ID NO: 241749 - DNA, 103 bp, Artificial Sequence
  Synthetic Polynucleotide
taatacgactcactatagggtacctcttgtagaaggctttcccacacaagaacagaggagacttgtgatggaaagccttaacctggcggcagcgcaaaagatg

SEQ ID NO: 241750 - DNA, 103 bp, Artificial Sequence
  Synthetic Polynucleotide
taatacgactcactatagggagtgagcctgtacctcttgtagaaggctttaacagaggagaaaagccatgtacaagaggaacctggcggcagcgcaaaagatg

SEQ ID NO: 241751 - DNA, 103 bp, Artificial Sequence
  Synthetic Polynucleotide
taatacgactcactatagggtctcgtgttcagtgagcctgtacctcttgtaacagaggagaacaagaatgacaggctcaaacctggcggcagcgcaaaagatg

SEQ ID NO: 241752 - DNA, 103 bp, Artificial Sequence
  Synthetic Polynucleotide
taatacgactcactatagggttgtgagctctctcgtgttcagtgagcctgaacagaggagacaggctatgtgaacacgaaacctggcggcagcgcaaaagatg

SEQ ID NO: 241753 - DNA, 103 bp, Artificial Sequence
  Synthetic Polynucleotide
taatacgactcactatagggtttctctcctttgtgagctctctcgtgttcaacagaggagagaacacatgagagctcacaacctggcggcagcgcaaaagatg

SEQ ID NO: 241754 - DNA, 103 bp, Artificial Sequence
  Synthetic Polynucleotide
taatacgactcactatagggacccgtatggtttctctcctttgtgagctcaacagaggagagagctcatgaaggagagaaacctggcggcagcgcaaaagatg

SEQ ID NO: 241755 - DNA, 103 bp, Artificial Sequence
  Synthetic Polynucleotide
taatacgactcactatagggcattcactgcacccgtatggtttctctcctaacagaggagaaggagaatgaccatacggaacctggcggcagcgcaaaagatg

SEQ ID NO: 241756 - DNA, 103 bp, Artificial Sequence
  Synthetic Polynucleotide
taatacgactcactatagggggctttcccacattcactgcacccgtatggaacagaggagaccatacatgtgcagtgaaaacctggcggcagcgcaaaagatg

SEQ ID NO: 241757 - DNA, 103 bp, Artificial Sequence
  Synthetic Polynucleotide
taatacgactcactatagggggtacaggtccttctgagcagggctcaggaaacagaggagatcctgaatgctgctcagaaacctggcggcagcgcaaaagatg

SEQ ID NO: 241758 - DNA, 103 bp, Artificial Sequence
  Synthetic Polynucleotide
taatacgactcactatagggtcctggggaaggctttcccacattcactgcaacagaggagagcagtgatggtgggaaagaacctggcggcagcgcaaaagatg

SEQ ID NO: 241759 - DNA, 103 bp, Artificial Sequence
  Synthetic Polynucleotide
taatacgactcactatagggagctcagatttcctggggaaggctttcccaaacagaggagatgggaaatgcttccccagaacctggcggcagcgcaaaagatg

SEQ ID NO: 241760 - DNA, 103 bp, Artificial Sequence
  Synthetic Polynucleotide
taatacgactcactatagggatgttcagtaagctcagatttcctggggaaaacagaggagattccccatgaaatctgagaacctggcggcagcgcaaaagatg

SEQ ID NO: 241761 - DNA, 103 bp, Artificial Sequence
  Synthetic Polynucleotide
taatacgactcactataggggaatcctttgatgttcagtaagctcagattaacagaggagaaatctgatgttactgaacaacctggcggcagcgcaaaagatg

SEQ ID NO: 241762 - DNA, 103 bp, Artificial Sequence
  Synthetic Polynucleotide
taatacgactcactatagggattcccgtgtgaatcctttgatgttcagtaaacagaggagatactgaatgtcaaaggataacctggcggcagcgcaaaagatg

SEQ ID NO: 241763 - DNA, 103 bp, Artificial Sequence
  Synthetic Polynucleotide
taatacgactcactatagggatggggcttaattcccgtgtgaatcctttgaacagaggagacaaaggatgcacacgggaaacctggcggcagcgcaaaagatg

SEQ ID NO: 241764 - DNA, 103 bp, Artificial Sequence
  Synthetic Polynucleotide
taatacgactcactatagggcgctgcattgatggggcttaattcccgtgtaacagaggagaacacggatgttaagccccaacctggcggcagcgcaaaagatg

SEQ ID NO: 241765 - DNA, 103 bp, Artificial Sequence
  Synthetic Polynucleotide
taatacgactcactatagggctcccacattcgctgcattgatggggcttaaacagaggagataagccatgtcaatgcagaacctggcggcagcgcaaaagatg

SEQ ID NO: 241766 - DNA, 103 bp, Artificial Sequence
  Synthetic Polynucleotide
taatacgactcactatagggggagaaagctctcccacattcgctgcattgaacagaggagacaatgcatggaatgtgggaacctggcggcagcgcaaaagatg

SEQ ID NO: 241767 - DNA, 103 bp, Artificial Sequence
  Synthetic Polynucleotide
taatacgactcactataggggtgattttctggagaaagctctcccacattaacagaggagaaatgtgatggagctttctaacctggcggcagcgcaaaagatg

SEQ ID NO: 241768 - DNA, 103 bp, Artificial Sequence; identical to SEQ ID NO: 238786
  Synthetic Polynucleotide

SEQ ID NO: 241769 - DNA, 103 bp, Artificial Sequence
  Synthetic Polynucleotide
taatacgactcactatagggacaacgagtagtgattttctggagaaagctaacagaggagaagctttatgcagaaaatcaacctggcggcagcgcaaaagatg

SEQ ID NO: 241770 - DNA, 103 bp, Artificial Sequence
  Synthetic Polynucleotide
taatacgactcactatagggtcgctgatgtacaacgagtagtgattttctaacagaggagaagaaaaatgctactcgttaacctggcggcagcgcaaaagatg

SEQ ID NO: 241771 - DNA, 103 bp, Artificial Sequence
  Synthetic Polynucleotide
taatacgactcactatagggctgtatgagttcgctgatgtacaacgagtaaacagaggagatactcgatgtacatcagcaacctggcggcagcgcaaaagatg

SEQ ID NO: 241772 - DNA, 103 bp, Artificial Sequence
  Synthetic Polynucleotide
taatacgactcactatagggggcttctctcctgtatgagttcgctgatgtaacagaggagaacatcaatgaactcatacaacctggcggcagcgcaaaagatg

SEQ ID NO: 241773 - DNA, 103 bp, Artificial Sequence
  Synthetic Polynucleotide
taatacgactcactataggggcatgtatgaggcttctctcctgtatgagtaacagaggagaactcatatgggagagaagaacctggcggcagcgcaaaagatg

SEQ ID NO: 241774 - DNA, 103 bp, Artificial Sequence
  Synthetic Polynucleotide
taatacgactcactatagggcacattcactgcatgtatgaggcttctctcaacagaggagagagagaatgctcatacataacctggcggcagcgcaaaagatg

SEQ ID NO: 241775 - DNA, 103 bp, Artificial Sequence
  Synthetic Polynucleotide
taatacgactcactatagggaagccttttccacattcactgcatgtatgaaacagaggagatcatacatgcagtgaatgaacctggcggcagcgcaaaagatg

SEQ ID NO: 241776 - DNA, 103 bp, Artificial Sequence
  Synthetic Polynucleotide
taatacgactcactatagggcttctgaatgaagccttttccacattcactaacagaggagaagtgaaatgggaaaaggcaacctggcggcagcgcaaaagatg

SEQ ID NO: 241777 - DNA, 103 bp, Artificial Sequence
  Synthetic Polynucleotide
taatacgactcactatagggtgagattgcccttctgaatgaagccttttcaacagaggagagaaaagatgtcattcagaaacctggcggcagcgcaaaagatg

SEQ ID NO: 241778 - DNA, 103 bp, Artificial Sequence
  Synthetic Polynucleotide
taatacgactcactatagggtgatgtatgttgagattgcccttctgaatgaacagaggagacattcaatggggcaatctaacctggcggcagcgcaaaagatg

SEQ ID NO: 241779 - DNA, 103 bp, Artificial Sequence
  Synthetic Polynucleotide
taatacgactcactataggggaatgacactgatgcctgagacatgttcataacagaggagaatgaacatgtctcaggcaaacctggcggcagcgcaaaagatg

SEQ ID NO: 241780 - DNA, 103 bp, Artificial Sequence
  Synthetic Polynucleotide
taatacgactcactataggggttctccagcatcacatctctgtacagcgtaacagaggagaacgctgatgagagatgtgaacctggcggcagcgcaaaagatg

SEQ ID NO: 241781 - DNA, 103 bp, Artificial Sequence
  Synthetic Polynucleotide
taatacgactcactatagggatgggctgagctctggctaaaattttcttcaacagaggagagaagaaatgtttagccagaacctggcggcagcgcaaaagatg

SEQ ID NO: 241782 - DNA, 103 bp, Artificial Sequence
  Synthetic Polynucleotide
taatacgactcactataggggatgtactatatgggctgagctctggctaaaacagaggagattagccatggctcagcccaacctggcggcagcgcaaaagatg

SEQ ID NO: 241783 - DNA, 103 bp, Artificial Sequence
  Synthetic Polynucleotide
taatacgactcactatagggtgtgttttctgatgtactatatgggctgagaacagaggagactcagcatgtatagtacaaacctggcggcagcgcaaaagatg

SEQ ID NO: 241784 - DNA, 103 bp, Artificial Sequence
  Synthetic Polynucleotide
taatacgactcactatagggatctccagcttgtgttttctgatgtactataacagaggagaatagtaatgcagaaaacaaacctggcggcagcgcaaaagatg

SEQ ID NO: 241785 - DNA, 103 bp, Artificial Sequence
  Synthetic Polynucleotide
taatacgactcactatagggcaccaaatttatctccagcttgtgttttctaacagaggagaagaaaaatgaagctggagaacctggcggcagcgcaaaagatg

SEQ ID NO: 241786 - DNA, 103 bp, Artificial Sequence
  Synthetic Polynucleotide
taatacgactcactatagggtcattatgttcaccaaatttatctccagctaacagaggagaagctggatgtaaatttggaacctggcggcagcgcaaaagatg

SEQ ID NO: 241787 - DNA, 103 bp, Artificial Sequence
  Synthetic Polynucleotide
taatacgactcactatagggatctgtacattcattatgttcaccaaatttaacagaggagaaaatttatggaacataataacctggcggcagcgcaaaagatg

SEQ ID NO: 241788 - DNA, 103 bp, Artificial Sequence
  Synthetic Polynucleotide
taatacgactcactatagggggtagagggcatctgtacattcattatgttaacagaggagaaacataatgaatgtacagaacctggcggcagcgcaaaagatg

SEQ ID NO: 241789 - DNA, 103 bp, Artificial Sequence
  Synthetic Polynucleotide
taatacgactcactatagggtctaatttctggtagagggcatctgtacataacagaggagaatgtacatgtgccctctaaacctggcggcagcgcaaaagatg

SEQ ID NO: 241790 - DNA, 103 bp, Artificial Sequence
  Synthetic Polynucleotide
taatacgactcactatagggtgctgtaaagtctaatttctggtagagggcaacagaggagagccctcatgcagaaattaaacctggcggcagcgcaaaagatg

SEQ ID NO: 241791 - DNA, 103 bp, Artificial Sequence
  Synthetic Polynucleotide
taatacgactcactatagggggtggctgtagttctccagcatcacatctcaacagaggagagagatgatgtgctggagaaacctggcggcagcgcaaaagatg

SEQ ID NO: 241792 - DNA, 103 bp, Artificial Sequence
  Synthetic Polynucleotide
taatacgactcactatagggttctctgatgtgctgtaaagtctaatttctaacagaggagaagaaatatgactttacagaacctggcggcagcgcaaaagatg

SEQ ID NO: 241793 - DNA, 103 bp, Artificial Sequence
  Synthetic Polynucleotide
taatacgactcactatagggtctgtgtgaattctctgatgtgctgtaaagaacagaggagactttacatgacatcagagaacctggcggcagcgcaaaagatg

SEQ ID NO: 241794 - DNA, 103 bp, Artificial Sequence
  Synthetic Polynucleotide
taatacgactcactataggggaatttatcttctgtgtgaattctctgatgaacagaggagacatcagatgattcacacaaacctggcggcagcgcaaaagatg

SEQ ID NO: 241795 - DNA, 103 bp, Artificial Sequence
  Synthetic Polynucleotide
taatacgactcactatagggcagaaaggtagaatttatcttctgtgtgaaaacagaggagattcacaatgaagataaataacctggcggcagcgcaaaagatg

SEQ ID NO: 241796 - DNA, 103 bp, Artificial Sequence
  Synthetic Polynucleotide
taatacgactcactatagggccatgttcatcagaaaggtagaatttatctaacagaggagaagataaatgctacctttcaacctggcggcagcgcaaaagatg

SEQ ID NO: 241797 - DNA, 103 bp, Artificial Sequence
  Synthetic Polynucleotide
taatacgactcactatagggtctgcatttcccatgttcatcagaaaggtaaacagaggagataccttatggatgaacataacctggcggcagcgcaaaagatg

SEQ ID NO: 241798 - DNA, 103 bp, Artificial Sequence
  Synthetic Polynucleotide
taatacgactcactatagggaaaaggattttctgcatttcccatgttcataacagaggagaatgaacatgggaaatgcaaacctggcggcagcgcaaaagatg

SEQ ID NO: 241799 - DNA, 103 bp, Artificial Sequence
  Synthetic Polynucleotide
taatacgactcactataggggctttccggtaaaaggattttctgcatttcaacagaggagagaaatgatgaaaatccttaacctggcggcagcgcaaaagatg

SEQ ID NO: 241800 - DNA, 103 bp, Artificial Sequence
  Synthetic Polynucleotide
taatacgactcactatagggaatgaggtgtgctttccggtaaaaggatttaacagaggagaaaatccatgtaccggaaaaacctggcggcagcgcaaaagatg

SEQ ID NO: 241801 - DNA, 103 bp, Artificial Sequence
  Synthetic Polynucleotide
taatacgactcactatagggtctgatgctgaatgaggtgtgctttccggtaacagaggagaaccggaatgcacacctcaaacctggcggcagcgcaaaagatg

SEQ ID NO: 241802 - DNA, 103 bp, Artificial Sequence
  Synthetic Polynucleotide
taatacgactcactatagggactgagatgaggtggctgtagttctccagcaacagaggagagctggaatgctacagccaaacctggcggcagcgcaaaagatg

SEQ ID NO: 241803 - DNA, 103 bp, Artificial Sequence
  Synthetic Polynucleotide
taatacgactcactataggggagtggggcctctgatgctgaatgaggtgtaacagaggagaacacctatgtcagcatcaaacctggcggcagcgcaaaagatg

SEQ ID NO: 241804 - DNA, 103 bp, Artificial Sequence
  Synthetic Polynucleotide
taatacgactcactatagggtttctctcctgagtggggcctctgatgctgaacagaggagacagcatatgaggccccacaacctggcggcagcgcaaaagatg

SEQ ID NO: 241805 - DNA, 103 bp, Artificial Sequence
  Synthetic Polynucleotide
taatacgactcactatagggattggtaagttttctctcctgagtggggccaacagaggagaggccccatgcaggagagaaacctggcggcagcgcaaaagatg

SEQ ID NO: 241806 - DNA, 103 bp, Artificial Sequence
  Synthetic Polynucleotide
taatacgactcactatagggcattcctcatattggtaagttttctctcctaacagaggagaaggagaatgaacttaccaaacctggcggcagcgcaaaagatg

SEQ ID NO: 241807 - DNA, 103 bp, Artificial Sequence
  Synthetic Polynucleotide
taatacgactcactatagggggattttgcacattcctcatattggtaagtaacagaggagaacttacatgtatgaggaaaacctggcggcagcgcaaaagatg

SEQ ID NO: 241808 - DNA, 103 bp, Artificial Sequence
  Synthetic Polynucleotide
taatacgactcactatagggttgaacaaaaggattttgcacattcctcataacagaggagaatgaggatggtgcaaaataacctggcggcagcgcaaaagatg

SEQ ID NO: 241809 - DNA, 103 bp, Artificial Sequence
  Synthetic Polynucleotide
taatacgactcactatagggggatgtgaacttgaacaaaaggattttgcaaacagaggagatgcaaaatgcttttgttcaacctggcggcagcgcaaaagatg

SEQ ID NO: 241810 - DNA, 103 bp, Artificial Sequence
  Synthetic Polynucleotide
taatacgactcactatagggatgctgaataggatgtgaacttgaacaaaaaacagaggagattttgtatgagttcacataacctggcggcagcgcaaaagatg

SEQ ID NO: 241811 - DNA, 103 bp, Artificial Sequence
  Synthetic Polynucleotide
taatacgactcactatagggaagttccaggatgctgaataggatgtgaacaacagaggagagttcacatgctattcagcaacctggcggcagcgcaaaagatg

SEQ ID NO: 241812 - DNA, 103 bp, Artificial Sequence
  Synthetic Polynucleotide
taatacgactcactatagggaatcccacataagttccaggatgctgaataaacagaggagatattcaatgtcctggaacaacctggcggcagcgcaaaagatg

SEQ ID NO: 241813 - DNA, 103 bp, Artificial Sequence
  Synthetic Polynucleotide
taatacgactcactataggggcaatatcccactgagatgaggtggctgtaaacagaggagatacagcatgctcatctcaaacctggcggcagcgcaaaagatg

SEQ ID NO: 241814 - DNA, 103 bp, Artificial Sequence
  Synthetic Polynucleotide
taatacgactcactatagggataaagtttgaatcccacataagttccaggaacagaggagacctggaatgtatgtgggaaacctggcggcagcgcaaaagatg

SEQ ID NO: 241815 - DNA, 103 bp, Artificial Sequence
  Synthetic Polynucleotide
taatacgactcactatagggcattacattcataaagtttgaatcccacataacagaggagaatgtggatgtcaaactttaacctggcggcagcgcaaaagatg

SEQ ID NO: 241816 - DNA, 103 bp, Artificial Sequence
  Synthetic Polynucleotide
taatacgactcactatagggttcccacattcattacattcataaagtttgaacagaggagacaaactatgtgaatgtaaaacctggcggcagcgcaaaagatg

SEQ ID NO: 241817 - DNA, 103 bp, Artificial Sequence
  Synthetic Polynucleotide
taatacgactcactatagggacagaaagctttcccacattcattacattcaacagaggagagaatgtatggaatgtgggaacctggcggcagcgcaaaagatg

SEQ ID NO: 241818 - DNA, 103 bp, Artificial Sequence
  Synthetic Polynucleotide
taatacgactcactatagggttgaattctgacagaaagctttcccacattaacagaggagaaatgtgatgaagctttctaacctggcggcagcgcaaaagatg

SEQ ID NO: 241819 - DNA, 103 bp, Artificial Sequence
  Synthetic Polynucleotide
taatacgactcactatagggttactgaggtttgaattctgacagaaagctaacagaggagaagctttatgtcagaattcaacctggcggcagcgcaaaagatg

SEQ ID NO: 241820 - DNA, 103 bp, Artificial Sequence
  Synthetic Polynucleotide
taatacgactcactatagggtctcagatgtttactgaggtttgaattctgaacagaggagacagaatatgaacctcagtaacctggcggcagcgcaaaagatg

SEQ ID NO: 241821 - DNA, 103 bp, Artificial Sequence
  Synthetic Polynucleotide
taatacgactcactatagggttgtgtgaattctcagatgtttactgaggtaacagaggagaacctcaatgaacatctgaaacctggcggcagcgcaaaagatg

SEQ ID NO: 241822 - DNA, 103 bp, Artificial Sequence
  Synthetic Polynucleotide
taatacgactcactatagggggtttctcttttgtgtgaattctcagatgtaacagaggagaacatctatgaattcacacaacctggcggcagcgcaaaagatg

SEQ ID NO: 241823 - DNA, 103 bp, Artificial Sequence
  Synthetic Polynucleotide
taatacgactcactataggggttatcacaaggtttctcttttgtgtgaataacagaggagaattcacatgaaagagaaaaacctggcggcagcgcaaaagatg

SEQ ID NO: 241824 - DNA, 103 bp, Artificial Sequence
  Synthetic Polynucleotide
taatacgactcactataggggtttagtaatgcaatatcccactgagatgaaacagaggagatcatctatgtgggatattaacctggcggcagcgcaaaagatg

SEQ ID NO: 241825 - DNA, 103 bp, Artificial Sequence
  Synthetic Polynucleotide
taatacgactcactatagggcacagccattgttatcacaaggtttctcttaacagaggagaaagagaatgcttgtgataaacctggcggcagcgcaaaagatg

SEQ ID NO: 241826 - DNA, 103 bp, Artificial Sequence
  Synthetic Polynucleotide
taatacgactcactatagggtaagatctcccacagccattgttatcacaaaacagaggagattgtgaatgcaatggctgaacctggcggcagcgcaaaagatg

SEQ ID NO: 241827 - DNA, 103 bp, Artificial Sequence
  Synthetic Polynucleotide
taatacgactcactataggggggtgacttgtaagatctcccacagccattaacagaggagaaatggcatggggagatctaacctggcggcagcgcaaaagatg

SEQ ID NO: 241828 - DNA, 103 bp, Artificial Sequence
  Synthetic Polynucleotide
taatacgactcactataggggtcctatgaggggtgacttgtaagatctccaacagaggagaggagatatgacaagtcacaacctggcggcagcgcaaaagatg

SEQ ID NO: 241829 - DNA, 103 bp, Artificial Sequence
  Synthetic Polynucleotide
taatacgactcactataggggttttctggtgtcctatgaggggtgacttgaacagaggagacaagtcatgcctcataggaacctggcggcagcgcaaaagatg

SEQ ID NO: 241830 - DNA, 103 bp, Artificial Sequence
  Synthetic Polynucleotide
taatacgactcactatagggctctgcatctgttttctggtgtcctatgagaacagaggagactcataatgcaccagaaaaacctggcggcagcgcaaaagatg

SEQ ID NO: 241831 - DNA, 103 bp, Artificial Sequence
  Synthetic Polynucleotide
taatacgactcactatagggagagttccatctctgcatctgttttctggtaacagaggagaaccagaatgcagatgcagaacctggcggcagcgcaaaagatg

SEQ ID NO: 241832 - DNA, 103 bp, Artificial Sequence
  Synthetic Polynucleotide
taatacgactcactatagggctgccaccacagagttccatctctgcatctaacagaggagaagatgcatggatggaactaacctggcggcagcgcaaaagatg

SEQ ID NO: 241833 - DNA, 103 bp, Artificial Sequence
  Synthetic Polynucleotide
taatacgactcactatagggcccatattcactgccaccacagagttccataacagaggagaatggaaatgtgtggtggcaacctggcggcagcgcaaaagatg

SEQ ID NO: 241834 - DNA, 103 bp, Artificial Sequence
  Synthetic Polynucleotide
taatacgactcactataggggtgatgtcttcccatattcactgccaccacaacagaggagagtggtgatggtgaatatgaacctggcggcagcgcaaaagatg

SEQ ID NO: 241835 - DNA, 103 bp, Artificial Sequence
  Synthetic Polynucleotide
taatacgactcactatagggatcaccttaggtttagtaatgcaatatcccaacagaggagagggataatgcattactaaaacctggcggcagcgcaaaagatg

SEQ ID NO: 241836 - DNA, 103 bp, Artificial Sequence
  Synthetic Polynucleotide
taatacgactcactatagggcctttgagatgtgatgtcttcccatattcaaacagaggagatgaataatggaagacatcaacctggcggcagcgcaaaagatg

SEQ ID NO: 241837 - DNA, 103 bp, Artificial Sequence
  Synthetic Polynucleotide
taatacgactcactatagggtctctgatgtcctttgagatgtgatgtcttaacagaggagaaagacaatgcatctcaaaaacctggcggcagcgcaaaagatg

SEQ ID NO: 241838 - DNA, 103 bp, Artificial Sequence
  Synthetic Polynucleotide
taatacgactcactatagggccatgagaattctctgatgtcctttgagataacagaggagaatctcaatggacatcagaaacctggcggcagcgcaaaagatg

SEQ ID NO: 241839 - DNA, 103 bp, Artificial Sequence
  Synthetic Polynucleotide
taatacgactcactatagggggtttctcccccatgagaattctctgatgtaacagaggagaacatcaatgaattctcataacctggcggcagcgcaaaagatg

SEQ ID NO: 241840 - DNA, 103 bp, Artificial Sequence
  Synthetic Polynucleotide
taatacgactcactatagggacattcatagggtttctcccccatgagaataacagaggagaattctcatgggggagaaaaacctggcggcagcgcaaaagatg

SEQ ID NO: 241841 - DNA, 103 bp, Artificial Sequence
  Synthetic Polynucleotide
taatacgactcactatagggcacattcaatacattcatagggtttctcccaacagaggagagggagaatgcctatgaataacctggcggcagcgcaaaagatg

SEQ ID NO: 241842 - DNA, 103 bp, Artificial Sequence
  Synthetic Polynucleotide
taatacgactcactatagggaaagttttcccacattcaatacattcatagaacagaggagactatgaatgtattgaatgaacctggcggcagcgcaaaagatg

SEQ ID NO: 241843 - DNA, 103 bp, Artificial Sequence
  Synthetic Polynucleotide
taatacgactcactatagggtgtcttggagaaagttttcccacattcaataacagaggagaattgaaatggggaaaactaacctggcggcagcgcaaaagatg

SEQ ID NO: 241844 - DNA, 103 bp, Artificial Sequence
  Synthetic Polynucleotide
taatacgactcactatagggtgagatgtgatgtcttggagaaagttttccaacagaggagaggaaaaatgtctccaagaaacctggcggcagcgcaaaagatg

SEQ ID NO: 241845 - DNA, 103 bp, Artificial Sequence
  Synthetic Polynucleotide
taatacgactcactatagggtgatgtgctctgagatgtgatgtcttggagaacagaggagactccaaatgatcacatctaacctggcggcagcgcaaaagatg

SEQ ID NO: 241846 - DNA, 103 bp, Artificial Sequence
  Synthetic Polynucleotide
taatacgactcactatagggcaacttggagatcaccttaggtttagtaataacagaggagaattactatgcctaaggtgaacctggcggcagcgcaaaagatg

SEQ ID NO: 241847 - DNA, 103 bp, Artificial Sequence
  Synthetic Polynucleotide
taatacgactcactataggggtgaattctctgatgtgctctgagatgtgaaacagaggagatcacatatgagagcacataacctggcggcagcgcaaaagatg

SEQ ID NO: 241848 - DNA, 103 bp, Artificial Sequence
  Synthetic Polynucleotide
taatacgactcactatagggtttcacctgtgtgaattctctgatgtgctcaacagaggagagagcacatgagagaattcaacctggcggcagcgcaaaagatg

SEQ ID NO: 241849 - DNA, 103 bp, Artificial Sequence
  Synthetic Polynucleotide
taatacgactcactatagggtcatagggtttttcacctgtgtgaattctcaacagaggagagagaatatgcacaggtgaaacctggcggcagcgcaaaagatg

SEQ ID NO: 241850 - DNA, 103 bp, Artificial Sequence
  Synthetic Polynucleotide
taatacgactcactatagggttcaacacattcatagggtttttcacctgtaacagaggagaacaggtatgaaaccctataacctggcggcagcgcaaaagatg

SEQ ID NO: 241851 - DNA, 103 bp, Artificial Sequence
  Synthetic Polynucleotide
taatacgactcactatagggttttctcacattcaacacattcatagggttaacagaggagaaaccctatgaatgtgttgaacctggcggcagcgcaaaagatg

SEQ ID NO: 241852 - DNA, 103 bp, Artificial Sequence
  Synthetic Polynucleotide
taatacgactcactatagggtgagagaaagttttctcacattcaacacataacagaggagaatgtgtatgatgtgagaaaacctggcggcagcgcaaaagatg

SEQ ID NO: 241853 - DNA, 103 bp, Artificial Sequence
  Synthetic Polynucleotide
taatacgactcactataggggtgtgtcttgtgagagaaagttttctcacaaacagaggagatgtgagatgactttctctaacctggcggcagcgcaaaagatg

SEQ ID NO: 241854 - DNA, 103 bp, Artificial Sequence
  Synthetic Polynucleotide
taatacgactcactataggggtacactgaggtgtgtcttgtgagagaaagaacagaggagactttctatgacaagacacaacctggcggcagcgcaaaagatg

SEQ ID NO: 241855 - DNA, 103 bp, Artificial Sequence
  Synthetic Polynucleotide
taatacgactcactatagggactctctgatgtacactgaggtgtgtcttgaacagaggagacaagacatgcctcagtgtaacctggcggcagcgcaaaagatg

SEQ ID NO: 241856 - DNA, 103 bp, Artificial Sequence
  Synthetic Polynucleotide
taatacgactcactatagggccctgtgtgaactctctgatgtacactgagaacagaggagactcagtatgcatcagagaaacctggcggcagcgcaaaagatg

SEQ ID NO: 241857 - DNA, 103 bp, Artificial Sequence
  Synthetic Polynucleotide
taatacgactcactatagggctcctttctccaacttggagatcaccttagaacagaggagactaaggatgtctccaagtaacctggcggcagcgcaaaagatg

SEQ ID NO: 241858 - DNA, 103 bp, Artificial Sequence
  Synthetic Polynucleotide
taatacgactcactatagggagggtttctcccctgtgtgaactctctgataacagaggagaatcagaatgttcacacagaacctggcggcagcgcaaaagatg

SEQ ID NO: 241859 - DNA, 103 bp, Artificial Sequence
  Synthetic Polynucleotide
taatacgactcactatagggttacattcatagggtttctcccctgtgtgaaacagaggagatcacacatgggagaaaccaacctggcggcagcgcaaaagatg

SEQ ID NO: 241860 - DNA, 103 bp, Artificial Sequence
  Synthetic Polynucleotide
taatacgactcactatagggcccacagtcattacattcatagggtttctcaacagaggagagagaaaatgtatgaatgtaacctggcggcagcgcaaaagatg

SEQ ID NO: 241861 - DNA, 103 bp, Artificial Sequence
  Synthetic Polynucleotide
taatacgactcactatagggtaaaagatttcccacagtcattacattcataacagaggagaatgaatatgatgactgtgaacctggcggcagcgcaaaagatg

SEQ ID NO: 241862 - DNA, 103 bp, Artificial Sequence
  Synthetic Polynucleotide
taatacgactcactataggggagttataggtaaaagatttcccacagtcaaacagaggagatgactgatggaaatctttaacctggcggcagcgcaaaagatg

SEQ ID NO: 241863 - DNA, 103 bp, Artificial Sequence
  Synthetic Polynucleotide
taatacgactcactatagggtctcagggctgagttataggtaaaagatttaacagaggagaaaatctatgacctataacaacctggcggcagcgcaaaagatg

SEQ ID NO: 241864 - DNA, 103 bp, Artificial Sequence
  Synthetic Polynucleotide
taatacgactcactatagggtttgatgtgctctcagggctgagttataggaacagaggagacctataatgcagccctgaaacctggcggcagcgcaaaagatg

SEQ ID NO: 241865 - DNA, 103 bp, Artificial Sequence
  Synthetic Polynucleotide
taatacgactcactataggggtgtgaattctttgatgtgctctcagggctaacagaggagaagccctatgagcacatcaaacctggcggcagcgcaaaagatg

SEQ ID NO: 241866 - DNA, 103 bp, Artificial Sequence
  Synthetic Polynucleotide
taatacgactcactatagggagcaagccctgtgtgaattctttgatgtgcaacagaggagagcacatatgagaattcacaacctggcggcagcgcaaaagatg

SEQ ID NO: 241867 - DNA, 103 bp, Artificial Sequence
  Synthetic Polynucleotide
taatacgactcactatagggcatgacagacagcaagccctgtgtgaattcaacagaggagagaattcatgcagggcttgaacctggcggcagcgcaaaagatg

SEQ ID NO: 241868 - DNA, 103 bp, Artificial Sequence
  Synthetic Polynucleotide
taatacgactcactatagggcatggctcttctcctttctccaacttggagaacagaggagactccaaatgggagaaaggaacctggcggcagcgcaaaagatg

SEQ ID NO: 241869 - DNA, 103 bp, Artificial Sequence
  Synthetic Polynucleotide
taatacgactcactatagggaagataccaacatgacagacagcaagccctaacagaggagaagggctatgtgtctgtcaaacctggcggcagcgcaaaagatg

SEQ ID NO: 241870 - DNA, 103 bp, Artificial Sequence
  Synthetic Polynucleotide
taatacgactcactatagggggtagccattaagataccaacatgacagacaacagaggagagtctgtatggttggtatcaacctggcggcagcgcaaaagatg

SEQ ID NO: 241871 - DNA, 103 bp, Artificial Sequence
  Synthetic Polynucleotide
taatacgactcactatagggacagactcttggtagccattaagataccaaaacagaggagattggtaatgtaatggctaaacctggcggcagcgcaaaagatg

SEQ ID NO: 241872 - DNA, 103 bp, Artificial Sequence
  Synthetic Polynucleotide
taatacgactcactataggggactgatgaaacagactcttggtagccattaacagaggagaaatggcatgcaagagtctaacctggcggcagcgcaaaagatg

SEQ ID NO: 241873 - DNA, 103 bp, Artificial Sequence
  Synthetic Polynucleotide
taatacgactcactatagggttctaaagaccatggctcttctcctttctcaacagaggagagagaaaatggaagagccaaacctggcggcagcgcaaaagatg

SEQ ID NO: 241874 - DNA, 103 bp, Artificial Sequence
  Synthetic Polynucleotide
taatacgactcactatagggtcacgtcctggaatgacactgatgcctgagaacagaggagactcaggatgcagtgtcataacctggcggcagcgcaaaagatg

SEQ ID NO: 241875 - DNA, 103 bp, Artificial Sequence
  Synthetic Polynucleotide
taatacgactcactatagggggaattcatcttctaaagaccatggctcttaacagaggagaaagagcatgggtctttagaacctggcggcagcgcaaaagatg

SEQ ID NO: 241876 - DNA, 103 bp, Artificial Sequence
  Synthetic Polynucleotide
taatacgactcactatagggctctggttcaggaattcatcttctaaagacaacagaggagagtctttatgagatgaattaacctggcggcagcgcaaaagatg

SEQ ID NO: 241877 - DNA, 103 bp, Artificial Sequence
  Synthetic Polynucleotide
taatacgactcactatagggccctgggtacctctggttcaggaattcatcaacagaggagagatgaaatgctgaaccagaacctggcggcagcgcaaaagatg

SEQ ID NO: 241878 - DNA, 103 bp, Artificial Sequence
  Synthetic Polynucleotide
taatacgactcactatagggctttaaaataccctgggtacctctggttcaaacagaggagatgaaccatgggtacccagaacctggcggcagcgcaaaagatg

SEQ ID NO: 241879 - DNA, 103 bp, Artificial Sequence
  Synthetic Polynucleotide
taatacgactcactatagggatgtgatcaactttaaaataccctgggtacaacagaggagagtacccatggtattttaaaacctggcggcagcgcaaaagatg

SEQ ID NO: 241880 - DNA, 103 bp, Artificial Sequence
  Synthetic Polynucleotide
taatacgactcactataggggatccctttgatgtgatcaactttaaaataaacagaggagatattttatggttgatcacaacctggcggcagcgcaaaagatg

SEQ ID NO: 241881 - DNA, 103 bp, Artificial Sequence
  Synthetic Polynucleotide
taatacgactcactataggggtttttcccggatccctttgatgtgatcaaaacagaggagattgatcatgtcaaagggaaacctggcggcagcgcaaaagatg

SEQ ID NO: 241882 - DNA, 103 bp, Artificial Sequence
  Synthetic Polynucleotide
taatacgactcactatagggggtttttcttgtttttcccggatccctttgaacagaggagacaaaggatgccgggaaaaaacctggcggcagcgcaaaagatg

SEQ ID NO: 241883 - DNA, 103 bp, Artificial Sequence
  Synthetic Polynucleotide
taatacgactcactatagggttgccacagaggtttttcttgtttttcccgaacagaggagacgggaaatgcaagaaaaaaacctggcggcagcgcaaaagatg

SEQ ID NO: 241884 - DNA, 103 bp, Artificial Sequence
  Synthetic Polynucleotide
taatacgactcactatagggtgaatatttcttgccacagaggtttttcttaacagaggagaaagaaaatgctctgtggcaacctggcggcagcgcaaaagatg

SEQ ID NO: 241885 - DNA, 103 bp, Artificial Sequence
  Synthetic Polynucleotide
taatacgactcactatagggaattccacagtcacgtcctggaatgacactaacagaggagaagtgtcatgccaggacgtaacctggcggcagcgcaaaagatg

SEQ ID NO: 241886 - DNA, 103 bp, Artificial Sequence
  Synthetic Polynucleotide
taatacgactcactataggggcatcactgatgaatatttcttgccacagaaacagaggagatctgtgatgagaaatattaacctggcggcagcgcaaaagatg

SEQ ID NO: 241887 - DNA, 103 bp, Artificial Sequence
  Synthetic Polynucleotide
taatacgactcactatagggtgttttgtcagcatcactgatgaatatttcaacagaggagagaaataatgatcagtgataacctggcggcagcgcaaaagatg

SEQ ID NO: 241888 - DNA, 103 bp, Artificial Sequence
  Synthetic Polynucleotide
taatacgactcactatagggctttactcaatgttttgtcagcatcactgaaacagaggagatcagtgatgctgacaaaaaacctggcggcagcgcaaaagatg

SEQ ID NO: 241889 - DNA, 103 bp, Artificial Sequence
  Synthetic Polynucleotide
taatacgactcactatagggttctgtccttctttactcaatgttttgtcaaacagaggagatgacaaatgattgagtaaaacctggcggcagcgcaaaagatg

SEQ ID NO: 241890 - DNA, 103 bp, Artificial Sequence
  Synthetic Polynucleotide
taatacgactcactatagggttctaaaactttctgtccttctttactcaaaacagaggagattgagtatggaaggacagaacctggcggcagcgcaaaagatg

SEQ ID NO: 241891 - DNA, 103 bp, Artificial Sequence
  Synthetic Polynucleotide
taatacgactcactatagggtaaatggtttttctaaaactttctgtccttaacagaggagaaaggacatgaagttttagaacctggcggcagcgcaaaagatg

SEQ ID NO: 241892 - DNA, 103 bp, Artificial Sequence
  Synthetic Polynucleotide
taatacgactcactatagggatttccagattaaatggtttttctaaaactaacagaggagaagttttatgaaaaccattaacctggcggcagcgcaaaagatg

SEQ ID NO: 241893 - DNA, 103 bp, Artificial Sequence
  Synthetic Polynucleotide
taatacgactcactatagggctctggagctatttccagattaaatggtttaacagaggagaaaaccaatgaatctggaaaacctggcggcagcgcaaaagatg

SEQ ID NO: 241894 - DNA, 103 bp, Artificial Sequence
  Synthetic Polynucleotide
taatacgactcactatagggtttctgaaagctctggagctatttccagataacagaggagaatctggatgtagctccagaacctggcggcagcgcaaaagatg

SEQ ID NO: 241895 - DNA, 103 bp, Artificial Sequence
  Synthetic Polynucleotide
taatacgactcactatagggcaggatattttttctgaaagctctggagctaacagaggagaagctccatggctttcagaaacctggcggcagcgcaaaagatg

SEQ ID NO: 241896 - DNA, 103 bp, Artificial Sequence
  Synthetic Polynucleotide
taatacgactcactatagggctcccgggtgaattccacagtcacgtcctgaacagaggagacaggacatgactgtggaaaacctggcggcagcgcaaaagatg

SEQ ID NO: 241897 - DNA, 103 bp, Artificial Sequence
  Synthetic Polynucleotide
taatacgactcactataggggtcacatttacaggatattttttctgaaagaacagaggagactttcaatgaaaatatccaacctggcggcagcgcaaaagatg

SEQ ID NO: 241898 - DNA, 103 bp, Artificial Sequence
  Synthetic Polynucleotide
taatacgactcactatagggttctgtgtgagtcacatttacaggatatttaacagaggagaaaatatatggtaaatgtgaacctggcggcagcgcaaaagatg

SEQ ID NO: 241899 - DNA, 103 bp, Artificial Sequence
  Synthetic Polynucleotide
taatacgactcactatagggggcaaattcattctgtgtgagtcacatttaaacagaggagataaatgatgctcacacagaacctggcggcagcgcaaaagatg

SEQ ID NO: 241900 - DNA, 103 bp, Artificial Sequence
  Synthetic Polynucleotide
taatacgactcactatagggagaagcaactggcaaattcattctgtgtgaaacagaggagatcacacatgatgaatttgaacctggcggcagcgcaaaagatg

SEQ ID NO: 241901 - DNA, 103 bp, Artificial Sequence
  Synthetic Polynucleotide
taatacgactcactatagggtaattaattgagaagcaactggcaaattcaaacagaggagatgaattatgcagttgcttaacctggcggcagcgcaaaagatg

SEQ ID NO: 241902 - DNA, 103 bp, Artificial Sequence
  Synthetic Polynucleotide
taatacgactcactatagggctttcacttataattaattgagaagcaactaacagaggagaagttgcatgtcaattaataacctggcggcagcgcaaaagatg

SEQ ID NO: 241903 - DNA, 103 bp, Artificial Sequence
  Synthetic Polynucleotide
taatacgactcactatagggtgaatattttctttcacttataattaattgaacagaggagacaattaatgataagtgaaaacctggcggcagcgcaaaagatg

SEQ ID NO: 241904 - DNA, 103 bp, Artificial Sequence
  Synthetic Polynucleotide
taatacgactcactatagggtcttctttcttgaatattttctttcacttaaacagaggagataagtgatggaaaatattaacctggcggcagcgcaaaagatg

SEQ ID NO: 241905 - DNA, 103 bp, Artificial Sequence
  Synthetic Polynucleotide
taatacgactcactatagggatgtattcagtcttctttcttgaatattttaacagaggagaaaaataatgaagaaagaaaacctggcggcagcgcaaaagatg

SEQ ID NO: 241906 - DNA, 103 bp, Artificial Sequence
  Synthetic Polynucleotide
taatacgactcactatagggacacacattcatgtattcagtcttctttctaacagaggagaagaaagatgactgaatacaacctggcggcagcgcaaaagatg

SEQ ID NO: 241907 - DNA, 103 bp, Artificial Sequence
  Synthetic Polynucleotide
taatacgactcactataggggctgccactcctcccgggtgaattccacagaacagaggagactgtggatgtcacccgggaacctggcggcagcgcaaaagatg

SEQ ID NO: 241908 - DNA, 103 bp, Artificial Sequence
  Synthetic Polynucleotide
taatacgactcactataggggcagtttctcacacacattcatgtattcagaacagaggagactgaatatgtgaatgtgtaacctggcggcagcgcaaaagatg

SEQ ID NO: 241909 - DNA, 103 bp, Artificial Sequence
  Synthetic Polynucleotide
taatacgactcactatagggatatcaagctgcagtttctcacacacattcaacagaggagagaatgtatgtgagaaactaacctggcggcagcgcaaaagatg

SEQ ID NO: 241910 - DNA, 103 bp, Artificial Sequence
  Synthetic Polynucleotide
taatacgactcactatagggctcatgcttaatatcaagctgcagtttctcaacagaggagagagaaaatgcagcttgataacctggcggcagcgcaaaagatg

SEQ ID NO: 241911 - DNA, 103 bp, Artificial Sequence
  Synthetic Polynucleotide
taatacgactcactatagggcatgagctttctcatgcttaatatcaagctaacagaggagaagcttgatgttaagcatgaacctggcggcagcgcaaaagatg

SEQ ID NO: 241912 - DNA, 103 bp, Artificial Sequence
  Synthetic Polynucleotide
taatacgactcactatagggttctcttcagcatgagctttctcatgcttaaacagaggagataagcaatggaaagctcaaacctggcggcagcgcaaaagatg

SEQ ID NO: 241913 - DNA, 103 bp, Artificial Sequence
  Synthetic Polynucleotide
taatacgactcactatagggttcataagatttctcttcagcatgagctttaacagaggagaaaagctatggctgaagagaacctggcggcagcgcaaaagatg

SEQ ID NO: 241914 - DNA, 103 bp, Artificial Sequence
  Synthetic Polynucleotide
taatacgactcactatagggtttcaccatgttcataagatttctcttcagaacagaggagactgaagatgaatcttatgaacctggcggcagcgcaaaagatg

SEQ ID NO: 241915 - DNA, 103 bp, Artificial Sequence
  Synthetic Polynucleotide
taatacgactcactataggggctttagcattttcaccatgttcataagataacagaggagaatcttaatgacatggtgaaacctggcggcagcgcaaaagatg

SEQ ID NO: 241916 - DNA, 103 bp, Artificial Sequence
  Synthetic Polynucleotide
taatacgactcactatagggataactgaaagctttagcattttcaccatgaacagaggagacatggtatgaatgctaaaaacctggcggcagcgcaaaagatg

SEQ ID NO: 241917 - DNA, 103 bp, Artificial Sequence
  Synthetic Polynucleotide
taatacgactcactataggggatctttcttataactgaaagctttagcataacagaggagaatgctaatgctttcagttaacctggcggcagcgcaaaagatg

SEQ ID NO: 241918 - DNA, 103 bp, Artificial Sequence
  Synthetic Polynucleotide
taatacgactcactataggggggcccaggtgctgccactcctcccgggtgaacagaggagacacccgatgggagtggcaaacctggcggcagcgcaaaagatg

SEQ ID NO: 241919 - DNA, 103 bp, Artificial Sequence
  Synthetic Polynucleotide
taatacgactcactatagggttccaatgctgatctttcttataactgaaaaacagaggagatttcagatgtaagaaagaaacctggcggcagcgcaaaagatg

SEQ ID NO: 241920 - DNA, 103 bp, Artificial Sequence
  Synthetic Polynucleotide
taatacgactcactatagggagtttgaaatttccaatgctgatctttcttaacagaggagaaagaaaatgcagcattggaacctggcggcagcgcaaaagatg

SEQ ID NO: 241921 - DNA, 103 bp, Artificial Sequence
  Synthetic Polynucleotide
taatacgactcactatagggattcctccaaagtttgaaatttccaatgctaacagaggagaagcattatgaatttcaaaaacctggcggcagcgcaaaagatg

SEQ ID NO: 241922 - DNA, 103 bp, Artificial Sequence
  Synthetic Polynucleotide
taatacgactcactatagggcattcaaaagattcctccaaagtttgaaataacagaggagaatttcaatgtttggaggaaacctggcggcagcgcaaaagatg

SEQ ID NO: 241923 - DNA, 103 bp, Artificial Sequence
  Synthetic Polynucleotide
taatacgactcactatagggagatccatcacattcaaaagattcctccaaaacagaggagattggagatgtcttttgaaaacctggcggcagcgcaaaagatg

SEQ ID NO: 241924 - DNA, 103 bp, Artificial Sequence
  Synthetic Polynucleotide
taatacgactcactatagggaaccttgtccagatccatcacattcaaaagaacagaggagacttttgatggtgatggataacctggcggcagcgcaaaagatg

SEQ ID NO: 241925 - DNA, 103 bp, Artificial Sequence
  Synthetic Polynucleotide
taatacgactcactatagggttatcatataaaccttgtccagatccatcaaacagaggagatgatggatgtggacaaggaacctggcggcagcgcaaaagatg

SEQ ID NO: 241926 - DNA, 103 bp, Artificial Sequence
  Synthetic Polynucleotide
taatacgactcactatagggacaaattgtcttatcatataaaccttgtccaacagaggagaggacaaatgttatatgataacctggcggcagcgcaaaagatg

SEQ ID NO: 241927 - DNA, 103 bp, Artificial Sequence
  Synthetic Polynucleotide
taatacgactcactataggggaggtgtaatacaaattgtcttatcatataaacagaggagatatatgatgagacaatttaacctggcggcagcgcaaaagatg

SEQ ID NO: 241928 - DNA, 103 bp, Artificial Sequence
  Synthetic Polynucleotide
taatacgactcactatagggagaaaactctgaggtgtaatacaaattgtcaacagaggagagacaatatgtattacaccaacctggcggcagcgcaaaagatg

SEQ ID NO: 241929 - DNA, 103 bp, Artificial Sequence
  Synthetic Polynucleotide
taatacgactcactatagggcctctcgacagggcccaggtgctgccactcaacagaggagagagtggatgcacctgggcaacctggcggcagcgcaaaagatg

SEQ ID NO: 241930 - DNA, 103 bp, Artificial Sequence
  Synthetic Polynucleotide
taatacgactcactatagggttctcctgttagaaaactctgaggtgtaataacagaggagaattacaatgcagagttttaacctggcggcagcgcaaaagatg

SEQ ID NO: 241931 - DNA, 103 bp, Artificial Sequence
  Synthetic Polynucleotide
taatacgactcactatagggtacaggacttttctcctgttagaaaactctaacagaggagaagagttatgtaacaggagaacctggcggcagcgcaaaagatg

SEQ ID NO: 241932 - DNA, 103 bp, Artificial Sequence
  Synthetic Polynucleotide
taatacgactcactatagggtcatcatccttacaggacttttctcctgttaacagaggagaaacaggatgaaagtcctgaacctggcggcagcgcaaaagatg

SEQ ID NO: 241933 - DNA, 103 bp, Artificial Sequence
  Synthetic Polynucleotide
taatacgactcactatagggttttctaaattcatcatccttacaggacttaacagaggagaaagtccatgaaggatgataacctggcggcagcgcaaaagatg

SEQ ID NO: 241934 - DNA, 103 bp, Artificial Sequence
  Synthetic Polynucleotide
taatacgactcactatagggtatcaaagttttttctaaattcatcatcctaacagaggagaaggatgatgaatttagaaaacctggcggcagcgcaaaagatg

SEQ ID NO: 241935 - DNA, 103 bp, Artificial Sequence
  Synthetic Polynucleotide
taatacgactcactatagggaaagtgattttatcaaagttttttctaaataacagaggagaatttagatgaaactttgaaacctggcggcagcgcaaaagatg

SEQ ID NO: 241936 - DNA, 103 bp, Artificial Sequence
  Synthetic Polynucleotide
taatacgactcactataggggtggttaaataaagtgattttatcaaagttaacagaggagaaactttatgaaaatcactaacctggcggcagcgcaaaagatg

SEQ ID NO: 241937 - DNA, 103 bp, Artificial Sequence
  Synthetic Polynucleotide
taatacgactcactatagggcagttctcatgtggttaaataaagtgatttaacagaggagaaaatcaatgtatttaaccaacctggcggcagcgcaaaagatg

SEQ ID NO: 241938 - DNA, 103 bp, Artificial Sequence
  Synthetic Polynucleotide
taatacgactcactatagggccccttgtgtcagttctcatgtggttaaataacagaggagaatttaaatgcatgagaacaacctggcggcagcgcaaaagatg

SEQ ID NO: 241939 - DNA, 103 bp, Artificial Sequence
  Synthetic Polynucleotide
taatacgactcactatagggagagcatttcccccttgtgtcagttctcataacagaggagaatgagaatggacacaaggaacctggcggcagcgcaaaagatg

SEQ ID NO: 241940 - DNA, 103 bp, Artificial Sequence
  Synthetic Polynucleotide
taatacgactcactatagggtgtacagcgtcctctcgacagggcccaggtaacagaggagaacctggatgctgtcgagaaacctggcggcagcgcaaaagatg

SEQ ID NO: 241941 - DNA, 103 bp, Artificial Sequence
  Synthetic Polynucleotide
taatacgactcactatagggcattaagatcagagcatttcccccttgtgtaacagaggagaacacaaatgggaaatgctaacctggcggcagcgcaaaagatg

SEQ ID NO: 241942 - DNA, 103 bp, Artificial Sequence
  Synthetic Polynucleotide
taatacgactcactataggggtcccatattcattaagatcagagcatttcaacagaggagagaaatgatgtgatcttaaaacctggcggcagcgcaaaagatg

SEQ ID NO: 241943 - DNA, 103 bp, Artificial Sequence
  Synthetic Polynucleotide
taatacgactcactataggggtcacaggatgtcccatattcattaagatcaacagaggagagatcttatggaatatgggaacctggcggcagcgcaaaagatg

SEQ ID NO: 241944 - DNA, 103 bp, Artificial Sequence
  Synthetic Polynucleotide
taatacgactcactatagggcggtggttttgtcacaggatgtcccatattaacagaggagaaatatgatgcatcctgtgaacctggcggcagcgcaaaagatg

SEQ ID NO: 241945 - DNA, 103 bp, Artificial Sequence
  Synthetic Polynucleotide
taatacgactcactatagggtattcaacagcggtggttttgtcacaggataacagaggagaatcctgatgcaaaaccacaacctggcggcagcgcaaaagatg

SEQ ID NO: 241946 - DNA, 103 bp, Artificial Sequence
  Synthetic Polynucleotide
taatacgactcactatagggaactttattgtattcaacagcggtggttttaacagaggagaaaaaccatggctgttgaaaacctggcggcagcgcaaaagatg

SEQ ID NO: 241947 - DNA, 103 bp, Artificial Sequence
  Synthetic Polynucleotide
taatacgactcactatagggtagccatgtgaactttattgtattcaacagaacagaggagactgttgatgacaataaagaacctggcggcagcgcaaaagatg

SEQ ID NO: 241948 - DNA, 103 bp, Artificial Sequence
  Synthetic Polynucleotide
taatacgactcactatagggtagtgtgtcatagccatgtgaactttattgaacagaggagacaataaatgtcacatggcaacctggcggcagcgcaaaagatg

SEQ ID NO: 241949 - DNA, 103 bp, Artificial Sequence
  Synthetic Polynucleotide
taatacgactcactatagggattacactcatagtgtgtcatagccatgtgaacagaggagacacatgatgatgacacacaacctggcggcagcgcaaaagatg

SEQ ID NO: 241950 - DNA, 103 bp, Artificial Sequence
  Synthetic Polynucleotide
taatacgactcactatagggtccccctttcattacactcatagtgtgtcaaacagaggagatgacacatgatgagtgtaaacctggcggcagcgcaaaagatg

SEQ ID NO: 241951 - DNA, 103 bp, Artificial Sequence
  Synthetic Polynucleotide
taatacgactcactatagggatcacatctctgtacagcgtcctctcgacaaacagaggagatgtcgaatggacgctgtaaacctggcggcagcgcaaaagatg

SEQ ID NO: 241952 - DNA, 103 bp, Artificial Sequence
  Synthetic Polynucleotide
taatacgactcactatagggctgaaattaatccccctttcattacactcaaacagaggagatgagtgatgtgaaaggggaacctggcggcagcgcaaaagatg

SEQ ID NO: 241953 - DNA, 103 bp, Artificial Sequence
  Synthetic Polynucleotide
taatacgactcactatagggtgacttcctactgaaattaatccccctttcaacagaggagagaaaggatgattaatttcaacctggcggcagcgcaaaagatg

SEQ ID NO: 241954 - DNA, 103 bp, Artificial Sequence
  Synthetic Polynucleotide
taatacgactcactataggggagtgaggggtgacttcctactgaaattaaaacagaggagattaattatggtaggaagtaacctggcggcagcgcaaaagatg

SEQ ID NO: 241955 - DNA, 103 bp, Artificial Sequence
  Synthetic Polynucleotide
taatacgactcactatagggctctgagattgagtgaggggtgacttcctaaacagaggagataggaaatgacccctcacaacctggcggcagcgcaaaagatg

SEQ ID NO: 241956 - DNA, 103 bp, Artificial Sequence
  Synthetic Polynucleotide
taatacgactcactatagggtgtaatagttctctgagattgagtgaggggaacagaggagacccctcatgcaatctcagaacctggcggcagcgcaaaagatg

SEQ ID NO: 241957 - DNA, 103 bp, Artificial Sequence
  Synthetic Polynucleotide
taatacgactcactatagggcactccatcctgtaatagttctctgagattaacagaggagaaatctcatggaactattaaacctggcggcagcgcaaaagatg

SEQ ID NO: 241958 - DNA, 103 bp, Artificial Sequence
  Synthetic Polynucleotide
taatacgactcactatagggctttcaaaagcactccatcctgtaatagttaacagaggagaaactatatgaggatggagaacctggcggcagcgcaaaagatg

SEQ ID NO: 241959 - DNA, 103 bp, Artificial Sequence
  Synthetic Polynucleotide
taatacgactcactatagggacatttattgctttcaaaagcactccatccaacagaggagaggatggatggcttttgaaaacctggcggcagcgcaaaagatg

SEQ ID NO: 241960 - DNA, 103 bp, Artificial Sequence
  Synthetic Polynucleotide
taatacgactcactatagggaattttcttcacatttattgctttcaaaagaacagaggagacttttgatggcaataaataacctggcggcagcgcaaaagatg

SEQ ID NO: 241961 - DNA, 103 bp, Artificial Sequence
  Synthetic Polynucleotide
taatacgactcactatagggctctggctaaaattttcttcacatttattgaacagaggagacaataaatgtgaagaaaaaacctggcggcagcgcaaaagatg

SEQ ID NO: 241962 - DNA, 103 bp, Artificial Sequence
  Synthetic Polynucleotide
taatacgactcactatagggcttcctgcccagcattcctggctctgacataacagaggagaatgtcaatgccaggaatgaacctggcggcagcgcaaaagatg

SEQ ID NO: 241963 - DNA, 103 bp, Artificial Sequence
  Synthetic Polynucleotide
taatacgactcactataggggcgcttgtagccgggggctggggaccgggcaacagaggagagcccggatgccagcccccaacctggcggcagcgcaaaagatg

SEQ ID NO: 241964 - DNA, 103 bp, Artificial Sequence
  Synthetic Polynucleotide
taatacgactcactataggggaagtccttgccgcacttctcgcagtggtaaacagaggagataccacatggagaagtgcaacctggcggcagcgcaaaagatg

SEQ ID NO: 241965 - DNA, 103 bp, Artificial Sequence
  Synthetic Polynucleotide
taatacgactcactatagggccggctgccggaagtccttgccgcacttctaacagaggagaagaagtatggcaaggactaacctggcggcagcgcaaaagatg

SEQ ID NO: 241966 - DNA, 103 bp, Artificial Sequence
  Synthetic Polynucleotide
taatacgactcactataggggccaggtccgccggctgccggaagtccttgaacagaggagacaaggaatgccggcagccaacctggcggcagcgcaaaagatg

SEQ ID NO: 241967 - DNA, 103 bp, Artificial Sequence
  Synthetic Polynucleotide
taatacgactcactatagggccggtgcatggccaggtccgccggctgccgaacagaggagacggcagatggcggacctgaacctggcggcagcgcaaaagatg

SEQ ID NO: 241968 - DNA, 103 bp, Artificial Sequence
  Synthetic Polynucleotide
taatacgactcactatagggtgtgcacacgccggtgcatggccaggtccgaacagaggagacggaccatgccatgcaccaacctggcggcagcgcaaaagatg

SEQ ID NO: 241969 - DNA, 103 bp, Artificial Sequence
  Synthetic Polynucleotide
taatacgactcactatagggcggtcgcctgtgtgcacacgccggtgcatgaacagaggagacatgcaatggcgtgtgcaaacctggcggcagcgcaaaagatg

SEQ ID NO: 241970 - DNA, 103 bp, Artificial Sequence
  Synthetic Polynucleotide
taatacgactcactatagggcttgaacggccggtcgcctgtgtgcacacgaacagaggagacgtgtgatgacaggcgacaacctggcggcagcgcaaaagatg

SEQ ID NO: 241971 - DNA, 103 bp, Artificial Sequence
  Synthetic Polynucleotide
taatacgactcactatagggattgcaggcacttgaacggccggtcgcctgaacagaggagacaggcgatgggccgttcaaacctggcggcagcgcaaaagatg

SEQ ID NO: 241972 - DNA, 103 bp, Artificial Sequence
  Synthetic Polynucleotide
taatacgactcactataggggtcttgtcacattgcaggcacttgaacggcaacagaggagagccgttatggtgcctgcaaacctggcggcagcgcaaaagatg

SEQ ID NO: 241973 - DNA, 103 bp, Artificial Sequence
  Synthetic Polynucleotide
taatacgactcactatagggcgccacgaacgtcttgtcacattgcaggcaaacagaggagatgcctgatgtgtgacaagaacctggcggcagcgcaaaagatg

SEQ ID NO: 241974 - DNA, 103 bp, Artificial Sequence
  Synthetic Polynucleotide
taatacgactcactatagggggcggcccgagcgcttgtagccgggggctgaacagaggagacagcccatggctacaagcaacctggcggcagcgcaaaagatg

SEQ ID NO: 241975 - DNA, 103 bp, Artificial Sequence
  Synthetic Polynucleotide
taatacgactcactatagggggtcccaggacgccacgaacgtcttgtcacaacagaggagagtgacaatgcgttcgtggaacctggcggcagcgcaaaagatg

SEQ ID NO: 241976 - DNA, 103 bp, Artificial Sequence
  Synthetic Polynucleotide
taatacgactcactatagggtgccgcttgaggtcccaggacgccacgaacaacagaggagagttcgtatggtcctgggaaacctggcggcagcgcaaaagatg

SEQ ID NO: 241977 - DNA, 103 bp, Artificial Sequence
  Synthetic Polynucleotide
taatacgactcactatagggcaccagcgcgtgccgcttgaggtcccaggaaacagaggagatcctggatgctcaagcggaacctggcggcagcgcaaaagatg

SEQ ID NO: 241978 - DNA, 103 bp, Artificial Sequence
  Synthetic Polynucleotide
taatacgactcactatagggggccagagtgcaccagcgcgtgccgcttgaaacagaggagatcaagcatgacgcgctggaacctggcggcagcgcaaaagatg

SEQ ID NO: 241979 - DNA, 103 bp, Artificial Sequence
  Synthetic Polynucleotide
taatacgactcactatagggaagggccgctggccagagtgcaccagcgcgaacagaggagacgcgctatggcactctggaacctggcggcagcgcaaaagatg

SEQ ID NO: 241980 - DNA, 103 bp, Artificial Sequence
  Synthetic Polynucleotide
taatacgactcactatagggctcacagcggaagggccgctggccagagtgaacagaggagacactctatgcagcggcccaacctggcggcagcgcaaaagatg

SEQ ID NO: 241981 - DNA, 103 bp, Artificial Sequence
  Synthetic Polynucleotide
taatacgactcactataggggcccgcactcctcacagcggaagggccgctaacagaggagaagcggcatgtccgctgtgaacctggcggcagcgcaaaagatg

SEQ ID NO: 241982 - DNA, 103 bp, Artificial Sequence
  Synthetic Polynucleotide
taatacgactcactataggggcgaaggctcgcccgcactcctcacagcggaacagaggagaccgctgatgggagtgcggaacctggcggcagcgcaaaagatg

SEQ ID NO: 241983 - DNA, 103 bp, Artificial Sequence
  Synthetic Polynucleotide
taatacgactcactatagggggcacgctcggcgaaggctcgcccgcactcaacagaggagagagtgcatgcgagccttcaacctggcggcagcgcaaaagatg

SEQ ID NO: 241984 - DNA, 103 bp, Artificial Sequence
  Synthetic Polynucleotide
taatacgactcactatagggtcgtgaggctggcacgctcggcgaaggctcaacagaggagagagcctatgccgagcgtgaacctggcggcagcgcaaaagatg

SEQ ID NO: 241985 - DNA, 103 bp, Artificial Sequence
  Synthetic Polynucleotide
taatacgactcactatagggcacttgtagcggcggcccgagcgcttgtagaacagaggagactacaaatgctcgggccgaacctggcggcagcgcaaaagatg

SEQ ID NO: 241986 - DNA, 103 bp, Artificial Sequence
  Synthetic Polynucleotide
taatacgactcactatagggcggctatgcttcgtgaggctggcacgctcgaacagaggagacgagcgatgcagcctcacaacctggcggcagcgcaaaagatg

SEQ ID NO: 241987 - DNA, 103 bp, Artificial Sequence
  Synthetic Polynucleotide
taatacgactcactatagggcgagtgcacccggctatgcttcgtgaggctaacagaggagaagcctcatgaagcatagcaacctggcggcagcgcaaaagatg

SEQ ID NO: 241988 - DNA, 103 bp, Artificial Sequence
  Synthetic Polynucleotide
taatacgactcactatagggggcgctcccccgagtgcacccggctatgctaacagaggagaagcataatggggtgcactaacctggcggcagcgcaaaagatg

SEQ ID NO: 241989 - DNA, 103 bp, Artificial Sequence
  Synthetic Polynucleotide
taatacgactcactatagggcagtggaaggggcgctcccccgagtgcaccaacagaggagaggtgcaatggggggagcgaacctggcggcagcgcaaaagatg

SEQ ID NO: 241990 - DNA, 103 bp, Artificial Sequence
  Synthetic Polynucleotide
taatacgactcactatagggacatgcgttacagtggaaggggcgctccccaacagaggagaggggagatgcccttccacaacctggcggcagcgcaaaagatg

SEQ ID NO: 241991 - DNA, 103 bp, Artificial Sequence
  Synthetic Polynucleotide
taatacgactcactatagggaggatttcccacatgcgttacagtggaaggaacagaggagaccttccatggtaacgcataacctggcggcagcgcaaaagatg

SEQ ID NO: 241992 - DNA, 103 bp, Artificial Sequence
  Synthetic Polynucleotide
taatacgactcactataggggacaccacaaaggatttcccacatgcgttaaacagaggagataacgcatgtgggaaatcaacctggcggcagcgcaaaagatg

SEQ ID NO: 241993 - DNA, 103 bp, Artificial Sequence
  Synthetic Polynucleotide
taatacgactcactatagggcaggctcgacgacaccacaaaggatttcccaacagaggagagggaaaatgtttgtggtgaacctggcggcagcgcaaaagatg

SEQ ID NO: 241994 - DNA, 103 bp, Artificial Sequence
  Synthetic Polynucleotide
taatacgactcactatagggcgtgcttcctcaggctcgacgacaccacaaaacagaggagattgtggatgcgtcgagccaacctggcggcagcgcaaaagatg

SEQ ID NO: 241995 - DNA, 103 bp, Artificial Sequence
  Synthetic Polynucleotide
taatacgactcactatagggtgggtccgctcgtgcttcctcaggctcgacaacagaggagagtcgagatggaggaagcaaacctggcggcagcgcaaaagatg

SEQ ID NO: 241996 - DNA, 103 bp, Artificial Sequence
  Synthetic Polynucleotide
taatacgactcactatagggacaggacaggcacttgtagcggcggcccgaaacagaggagatcgggcatgcgctacaagaacctggcggcagcgcaaaagatg

SEQ ID NO: 241997 - DNA, 103 bp, Artificial Sequence
  Synthetic Polynucleotide
taatacgactcactatagggactgcttcgatgggtccgctcgtgcttcctaacagaggagaaggaagatggagcggaccaacctggcggcagcgcaaaagatg

SEQ ID NO: 241998 - DNA, 103 bp, Artificial Sequence
  Synthetic Polynucleotide
taatacgactcactatagggccgcggcctcactgcttcgatgggtccgctaacagaggagaagcggaatgatcgaagcaaacctggcggcagcgcaaaagatg

SEQ ID NO: 241999 - DNA, 103 bp, Artificial Sequence
  Synthetic Polynucleotide
taatacgactcactataggggggggcacacccgcggcctcactgcttcgaaacagaggagatcgaagatgtgaggccgcaacctggcggcagcgcaaaagatg

SEQ ID NO: 242000 - DNA, 103 bp, Artificial Sequence
  Synthetic Polynucleotide
taatacgactcactatagggctcctgtgcagggggcacacccgcggcctcaacagaggagagaggccatgggtgtgcccaacctggcggcagcgcaaaagatg

SEQ ID NO: 242001 - DNA, 103 bp, Artificial Sequence
  Synthetic Polynucleotide
taatacgactcactatagggccaccaccagctcctgtgcagggggcacacaacagaggagagtgtgcatgctgcacaggaacctggcggcagcgcaaaagatg

SEQ ID NO: 242002 - DNA, 103 bp, Artificial Sequence
  Synthetic Polynucleotide
taatacgactcactatagggagcgccaaccccaccaccagctcctgtgcaaacagaggagatgcacaatggctggtggtaacctggcggcagcgcaaaagatg

SEQ ID NO: 242003 - DNA, 103 bp, Artificial Sequence
  Synthetic Polynucleotide
taatacgactcactataggggcccacaggcagcgccaaccccaccaccagaacagaggagactggtgatggggttggcgaacctggcggcagcgcaaaagatg

SEQ ID NO: 242004 - DNA, 103 bp, Artificial Sequence
  Synthetic Polynucleotide
taatacgactcactatagggcacctgccacgcccacaggcagcgccaaccaacagaggagaggttggatgtgcctgtggaacctggcggcagcgcaaaagatg

SEQ ID NO: 242005 - DNA, 103 bp, Artificial Sequence
  Synthetic Polynucleotide
taatacgactcactataggggctgaactctcacctgccacgcccacaggcaacagaggagagcctgtatgcgtggcaggaacctggcggcagcgcaaaagatg

SEQ ID NO: 242006 - DNA, 103 bp, Artificial Sequence
  Synthetic Polynucleotide
taatacgactcactatagggtgccggggcggctgaactctcacctgccacaacagaggagagtggcaatggagagttcaaacctggcggcagcgcaaaagatg

SEQ ID NO: 242007 - DNA, 103 bp, Artificial Sequence
  Synthetic Polynucleotide
taatacgactcactatagggatgtcttggtacaggacaggcacttgtagcaacagaggagagctacaatggcctgtcctaacctggcggcagcgcaaaagatg

SEQ ID NO: 242008 - DNA, 103 bp, Artificial Sequence
  Synthetic Polynucleotide
taatacgactcactatagggccgcccctgctgccggggcggctgaactctaacagaggagaagagttatgccgccccggaacctggcggcagcgcaaaagatg

SEQ ID NO: 242009 - DNA, 103 bp, Artificial Sequence
  Synthetic Polynucleotide
taatacgactcactatagggtcccccagccccgcccctgctgccggggcgaacagaggagacgccccatgagcaggggcaacctggcggcagcgcaaaagatg

SEQ ID NO: 242010 - DNA, 103 bp, Artificial Sequence
  Synthetic Polynucleotide
taatacgactcactatagggtgctggagggtcccccagccccgcccctgcaacagaggagagcagggatggggctggggaacctggcggcagcgcaaaagatg

SEQ ID NO: 242011 - DNA, 103 bp, Artificial Sequence
  Synthetic Polynucleotide
taatacgactcactatagggctagcagccctgctggagggtcccccagccaacagaggagaggctggatgaccctccagaacctggcggcagcgcaaaagatg

SEQ ID NO: 242012 - DNA, 103 bp, Artificial Sequence
  Synthetic Polynucleotide
taatacgactcactataggggggggcagccctagcagccctgctggagggaacagaggagaccctccatgagggctgctaacctggcggcagcgcaaaagatg

SEQ ID NO: 242013 - DNA, 103 bp, Artificial Sequence
  Synthetic Polynucleotide
taatacgactcactatagggacctgactccgggggcagccctagcagcccaacagaggagagggctgatggggctgcccaacctggcggcagcgcaaaagatg

SEQ ID NO: 242014 - DNA, 103 bp, Artificial Sequence
  Synthetic Polynucleotide
taatacgactcactatagggccatcacaccacctgactccgggggcagccaacagaggagaggctgcatgcggagtcagaacctggcggcagcgcaaaagatg

SEQ ID NO: 242015 - DNA, 103 bp, Artificial Sequence
  Synthetic Polynucleotide
taatacgactcactatagggcactgtgtggccatcacaccacctgactccaacagaggagaggagtcatgtggtgtgataacctggcggcagcgcaaaagatg

SEQ ID NO: 242016 - DNA, 103 bp, Artificial Sequence
  Synthetic Polynucleotide
taatacgactcactatagggcaccacctgccactgtgtggccatcacaccaacagaggagaggtgtgatggccacacagaacctggcggcagcgcaaaagatg

SEQ ID NO: 242017 - DNA, 103 bp, Artificial Sequence
  Synthetic Polynucleotide
taatacgactcactatagggccgtcatgcccaccacctgccactgtgtggaacagaggagaccacacatgggcaggtggaacctggcggcagcgcaaaagatg

SEQ ID NO: 242018 - DNA, 103 bp, Artificial Sequence
  Synthetic Polynucleotide
taatacgactcactataggggcgtttggaaatgtcttggtacaggacaggaacagaggagacctgtcatgtaccaagacaacctggcggcagcgcaaaagatg

SEQ ID NO: 242019 - DNA, 103 bp, Artificial Sequence
  Synthetic Polynucleotide
taatacgactcactatagggacatgctccaccgtcatgcccaccacctgcaacagaggagagcaggtatggggcatgacaacctggcggcagcgcaaaagatg

SEQ ID NO: 242020 - DNA, 103 bp, Artificial Sequence
  Synthetic Polynucleotide
taatacgactcactatagggttggcattccacatgctccaccgtcatgccaacagaggagaggcatgatggtggagcataacctggcggcagcgcaaaagatg

SEQ ID NO: 242021 - DNA, 103 bp, Artificial Sequence
  Synthetic Polynucleotide
taatacgactcactatagggcaccagcatcttggcattccacatgctccaaacagaggagatggagcatgtggaatgccaacctggcggcagcgcaaaagatg

SEQ ID NO: 242022 - DNA, 103 bp, Artificial Sequence
  Synthetic Polynucleotide
taatacgactcactataggggcctcccggacaccagcatcttggcattccaacagaggagaggaatgatgagatgctggaacctggcggcagcgcaaaagatg

SEQ ID NO: 242023 - DNA, 103 bp, Artificial Sequence
  Synthetic Polynucleotide
taatacgactcactataggggggaccaggagcctcccggacaccagcatcaacagaggagagatgctatggtccgggagaacctggcggcagcgcaaaagatg

SEQ ID NO: 242024 - DNA, 103 bp, Artificial Sequence
  Synthetic Polynucleotide
taatacgactcactatagggccccttccaagggaccaggagcctcccggaaacagaggagatccgggatgctcctggtcaacctggcggcagcgcaaaagatg

SEQ ID NO: 242025 - DNA, 103 bp, Artificial Sequence
  Synthetic Polynucleotide
taatacgactcactataggggcctcgcctgccccttccaagggaccaggaaacagaggagatcctggatgcttggaaggaacctggcggcagcgcaaaagatg

SEQ ID NO: 242026 - DNA, 103 bp, Artificial Sequence
  Synthetic Polynucleotide
taatacgactcactatagggctcaccccccgcctcgcctgccccttccaaaacagaggagattggaaatggcaggcgagaacctggcggcagcgcaaaagatg

SEQ ID NO: 242027 - DNA, 103 bp, Artificial Sequence
  Synthetic Polynucleotide
taatacgactcactatagggcgtcagcctcctcaccccccgcctcgcctgaacagaggagacaggcgatgcggggggtgaacctggcggcagcgcaaaagatg

SEQ ID NO: 242028 - DNA, 103 bp, Artificial Sequence
  Synthetic Polynucleotide
taatacgactcactataggggggggcttctcgtcagcctcctcaccccccaacagaggagaggggggatgggaggctgaaacctggcggcagcgcaaaagatg

SEQ ID NO: 242029 - DNA, 103 bp, Artificial Sequence
  Synthetic Polynucleotide
taatacgactcactatagggtgccctgggcgcgtttggaaatgtcttggtaacagaggagaaccaagatgtttccaaacaacctggcggcagcgcaaaagatg

SEQ ID NO: 242030 - DNA, 103 bp, Artificial Sequence
  Synthetic Polynucleotide
taatacgactcactatagggcacaaactgggggggcttctcgtcagcctcaacagaggagagaggctatggagaagcccaacctggcggcagcgcaaaagatg

SEQ ID NO: 242031 - DNA, 103 bp, Artificial Sequence
  Synthetic Polynucleotide
taatacgactcactatagggactctcggcacacaaactgggggggcttctaacagaggagaagaagcatgcccagtttgaacctggcggcagcgcaaaagatg

SEQ ID NO: 242032 - DNA, 103 bp, Artificial Sequence
  Synthetic Polynucleotide
taatacgactcactataggggtctccttgcactctcggcacacaaactggaacagaggagaccagttatggtgccgagaaacctggcggcagcgcaaaagatg

SEQ ID NO: 242033 - DNA, 103 bp, Artificial Sequence
  Synthetic Polynucleotide
taatacgactcactatagggtgtggagaaggtctccttgcactctcggcaaacagaggagatgccgaatgtgcaaggagaacctggcggcagcgcaaaagatg

SEQ ID NO: 242034 - DNA, 103 bp, Artificial Sequence
  Synthetic Polynucleotide
taatacgactcactataggggcagcgtcattgtggagaaggtctccttgcaacagaggagagcaaggatgccttctccaaacctggcggcagcgcaaaagatg

SEQ ID NO: 242035 - DNA, 103 bp, Artificial Sequence
  Synthetic Polynucleotide
taatacgactcactatagggtgccgacgcagcagcgtcattgtggagaagaacagaggagacttctcatgaatgacgctaacctggcggcagcgcaaaagatg

SEQ ID NO: 242036 - DNA, 103 bp, Artificial Sequence
  Synthetic Polynucleotide
taatacgactcactatagggtgagcgctcgtgccgacgcagcagcgtcataacagaggagaatgacgatgctgcgtcggaacctggcggcagcgcaaaagatg

SEQ ID NO: 242037 - DNA, 103 bp, Artificial Sequence
  Synthetic Polynucleotide
taatacgactcactataggggctccgggtgtgagcgctcgtgccgacgcaaacagaggagatgcgtcatgacgagcgctaacctggcggcagcgcaaaagatg

SEQ ID NO: 242038 - DNA, 103 bp, Artificial Sequence
  Synthetic Polynucleotide
taatacgactcactatagggaagggccggagctccgggtgtgagcgctcgaacagaggagacgagcgatgacacccggaaacctggcggcagcgcaaaagatg

SEQ ID NO: 242039 - DNA, 103 bp, Artificial Sequence
  Synthetic Polynucleotide
taatacgactcactatagggggtgcaggggaagggccggagctccgggtgaacagaggagacacccgatgctccggcccaacctggcggcagcgcaaaagatg

SEQ ID NO: 242040 - DNA, 103 bp, Artificial Sequence
  Synthetic Polynucleotide
taatacgactcactatagggcgtggcgcgctgccctgggcgcgtttggaaaacagaggagattccaaatgcgcccagggaacctggcggcagcgcaaaagatg

SEQ ID NO: 242041 - DNA, 103 bp, Artificial Sequence
  Synthetic Polynucleotide
taatacgactcactatagggtgccgcactgggtgcaggggaagggccggaaacagaggagatccggcatgtcccctgcaaacctggcggcagcgcaaaagatg

SEQ ID NO: 242042 - DNA, 103 bp, Artificial Sequence
  Synthetic Polynucleotide
taatacgactcactataggggagaagctcttgccgcactgggtgcaggggaacagaggagacccctgatgccagtgcggaacctggcggcagcgcaaaagatg

SEQ ID NO: 242043 - DNA, 103 bp, Artificial Sequence
  Synthetic Polynucleotide
taatacgactcactatagggagcccggtcagagaagctcttgccgcactgaacagaggagacagtgcatgaagagcttcaacctggcggcagcgcaaaagatg

SEQ ID NO: 242044 - DNA, 103 bp, Artificial Sequence
  Synthetic Polynucleotide
taatacgactcactatagggtgcgcagcccagcccggtcagagaagctctaacagaggagaagagctatgctgaccgggaacctggcggcagcgcaaaagatg

SEQ ID NO: 242045 - DNA, 103 bp, Artificial Sequence
  Synthetic Polynucleotide
taatacgactcactatagggcggctgtgtttgcgcagcccagcccggtcaaacagaggagatgaccgatgtgggctgcgaacctggcggcagcgcaaaagatg

SEQ ID NO: 242046 - DNA, 103 bp, Artificial Sequence
  Synthetic Polynucleotide
taatacgactcactataggggctgtgagtgcggctgtgtttgcgcagcccaacagaggagagggctgatgaaacacagcaacctggcggcagcgcaaaagatg

SEQ ID NO: 242047 - DNA, 103 bp, Artificial Sequence
  Synthetic Polynucleotide
taatacgactcactatagggggcgcactgagctgtgagtgcggctgtgttaacagaggagaaacacaatggcactcacaaacctggcggcagcgcaaaagatg

SEQ ID NO: 242048 - DNA, 103 bp, Artificial Sequence
  Synthetic Polynucleotide
taatacgactcactatagggcaggtgtaggggcgcactgagctgtgagtgaacagaggagacactcaatgctcagtgcgaacctggcggcagcgcaaaagatg

SEQ ID NO: 242049 - DNA, 103 bp, Artificial Sequence
  Synthetic Polynucleotide
taatacgactcactatagggacaatgggggcaggtgtaggggcgcactgaaacagaggagatcagtgatgccctacaccaacctggcggcagcgcaaaagatg

SEQ ID NO: 242050 - DNA, 103 bp, Artificial Sequence
  Synthetic Polynucleotide
taatacgactcactatagggaggccttgggacaatgggggcaggtgtaggaacagaggagacctacaatggcccccattaacctggcggcagcgcaaaagatg

SEQ ID NO: 242051 - DNA, 103 bp, Artificial Sequence
  Synthetic Polynucleotide
taatacgactcactatagggtgtgtggcagcgtggcgcgctgccctgggcaacagaggagagcccagatgagcgcgccaaacctggcggcagcgcaaaagatg

SEQ ID NO: 242052 - DNA, 103 bp, Artificial Sequence
  Synthetic Polynucleotide
taatacgactcactataggggcactcaagaaggccttgggacaatgggggaacagaggagacccccaatgtcccaaggcaacctggcggcagcgcaaaagatg

SEQ ID NO: 242053 - DNA, 103 bp, Artificial Sequence
  Synthetic Polynucleotide
taatacgactcactatagggcaagtcgctggcactcaagaaggccttgggaacagaggagacccaagatgttcttgagtaacctggcggcagcgcaaaagatg

SEQ ID NO: 242054 - DNA, 103 bp, Artificial Sequence
  Synthetic Polynucleotide
taatacgactcactatagggcatgcttgcgcaagtcgctggcactcaagaaacagaggagatcttgaatgccagcgactaacctggcggcagcgcaaaagatg

SEQ ID NO: 242055 - DNA, 103 bp, Artificial Sequence
  Synthetic Polynucleotide
taatacgactcactatagggtgggtgcgttcatgcttgcgcaagtcgctgaacagaggagacagcgaatggcgcaagcaaacctggcggcagcgcaaaagatg

SEQ ID NO: 242056 - DNA, 103 bp, Artificial Sequence
  Synthetic Polynucleotide
taatacgactcactataggggggcacagggtgggtgcgttcatgcttgcgaacagaggagacgcaagatggaacgcaccaacctggcggcagcgcaaaagatg

SEQ ID NO: 242057 - DNA, 103 bp, Artificial Sequence
  Synthetic Polynucleotide
taatacgactcactataggggggtccccatgggcacagggtgggtgcgttaacagaggagaaacgcaatgaccctgtgcaacctggcggcagcgcaaaagatg

SEQ ID NO: 242058 - DNA, 103 bp, Artificial Sequence
  Synthetic Polynucleotide
taatacgactcactatagggaggggtgtgggggtccccatgggcacagggaacagaggagaccctgtatgcatggggacaacctggcggcagcgcaaaagatg

SEQ ID NO: 242059 - DNA, 103 bp, Artificial Sequence
  Synthetic Polynucleotide
taatacgactcactatagggcaggggctccaggggtgtgggggtccccataacagaggagaatggggatgcccacacccaacctggcggcagcgcaaaagatg

SEQ ID NO: 242060 - DNA, 103 bp, Artificial Sequence
  Synthetic Polynucleotide
taatacgactcactataggggcaaagccaccaggggctccaggggtgtggaacagaggagaccacacatgtggagccccaacctggcggcagcgcaaaagatg

SEQ ID NO: 242061 - DNA, 103 bp, Artificial Sequence
  Synthetic Polynucleotide
taatacgactcactatagggggcattcctagcaaagccaccaggggctccaacagaggagaggagccatgggtggctttaacctggcggcagcgcaaaagatg

SEQ ID NO: 242062 - DNA, 103 bp, Artificial Sequence
  Synthetic Polynucleotide
taatacgactcactatagggtgccggcccatgtgtggcagcgtggcgcgcaacagaggagagcgcgcatggctgccacaaacctggcggcagcgcaaaagatg

SEQ ID NO: 242063 - DNA, 103 bp, Artificial Sequence
  Synthetic Polynucleotide
taatacgactcactatagggcccctcttcaggcattcctagcaaagccacaacagaggagagtggctatgctaggaatgaacctggcggcagcgcaaaagatg

SEQ ID NO: 242064 - DNA, 103 bp, Artificial Sequence
  Synthetic Polynucleotide
taatacgactcactatagggcccacacatccttcctgcccagcattcctgaacagaggagacaggaaatgtgggcaggaaacctggcggcagcgcaaaagatg

SEQ ID NO: 242065 - DNA, 103 bp, Artificial Sequence
  Synthetic Polynucleotide
taatacgactcactatagggcagagcagtctgccggcccatgtgtggcagaacagaggagactgccaatgatgggccggaacctggcggcagcgcaaaagatg

SEQ ID NO: 242066 - DNA, 103 bp, Artificial Sequence
  Synthetic Polynucleotide
taatacgactcactataggggccacctcttcagagcagtctgccggcccaaacagaggagatgggccatgagactgctcaacctggcggcagcgcaaaagatg

SEQ ID NO: 242067 - DNA, 103 bp, Artificial Sequence
  Synthetic Polynucleotide
taatacgactcactatagggcttcacctcggccacctcttcagagcagtcaacagaggagagactgcatggaagaggtgaacctggcggcagcgcaaaagatg

SEQ ID NO: 242068 - DNA, 103 bp, Artificial Sequence
  Synthetic Polynucleotide
taatacgactcactatagggctggctttggcttcacctcggccacctcttaacagaggagaaagaggatgccgaggtgaaacctggcggcagcgcaaaagatg

SEQ ID NO: 242069 - DNA, 103 bp, Artificial Sequence
  Synthetic Polynucleotide
taatacgactcactataggggcttctgtctctggctttggcttcacctcgaacagaggagacgaggtatggccaaagccaacctggcggcagcgcaaaagatg

SEQ ID NO: 242070 - DNA, 103 bp, Artificial Sequence
  Synthetic Polynucleotide
taatacgactcactatagggctctgccttagcttctgtctctggctttggaacagaggagaccaaagatggagacagaaaacctggcggcagcgcaaaagatg

SEQ ID NO: 242071 - DNA, 103 bp, Artificial Sequence
  Synthetic Polynucleotide
taatacgactcactatagggcactggcttcctctgccttagcttctgtctaacagaggagaagacagatgctaaggcagaacctggcggcagcgcaaaagatg

SEQ ID NO: 242072 - DNA, 103 bp, Artificial Sequence
  Synthetic Polynucleotide
taatacgactcactatagggaccttctccccactggcttcctctgccttaaacagaggagataaggcatgggaagccagaacctggcggcagcgcaaaagatg

SEQ ID NO: 242073 - DNA, 103 bp, Artificial Sequence
  Synthetic Polynucleotide
taatacgactcactatagggggagcctgacaccttctccccactggcttcaacagaggagagaagccatgggggagaagaacctggcggcagcgcaaaagatg

SEQ ID NO: 242074 - DNA, 103 bp, Artificial Sequence
  Synthetic Polynucleotide
taatacgactcactataggggcttggccgcggagcctgacaccttctcccaacagaggagagggagaatgtgtcaggctaacctggcggcagcgcaaaagatg

SEQ ID NO: 242075 - DNA, 103 bp, Artificial Sequence
  Synthetic Polynucleotide
taatacgactcactatagggtctctcggaacccacacatccttcctgcccaacagaggagagggcagatgggatgtgtgaacctggcggcagcgcaaaagatg

SEQ ID NO: 242076 - DNA, 103 bp, Artificial Sequence
  Synthetic Polynucleotide
taatacgactcactatagggtagggcctaggcttggccgcggagcctgacaacagaggagagtcaggatgcgcggccaaaacctggcggcagcgcaaaagatg

SEQ ID NO: 242077 - DNA, 103 bp, Artificial Sequence
  Synthetic Polynucleotide
taatacgactcactatagggcggacacgcatagggcctaggcttggccgcaacagaggagagcggccatgcctaggcccaacctggcggcagcgcaaaagatg

SEQ ID NO: 242078 - DNA, 103 bp, Artificial Sequence
  Synthetic Polynucleotide
taatacgactcactatagggtggggcatagcggacacgcatagggcctagaacagaggagactaggcatgatgcgtgtcaacctggcggcagcgcaaaagatg

SEQ ID NO: 242079 - DNA, 103 bp, Artificial Sequence
  Synthetic Polynucleotide
taatacgactcactatagggttgtaggccttggggcatagcggacacgcaaacagaggagatgcgtgatggctatgcccaacctggcggcagcgcaaaagatg

SEQ ID NO: 242080 - DNA, 103 bp, Artificial Sequence
  Synthetic Polynucleotide
taatacgactcactataggggggtgccgtcttgtaggccttggggcatagaacagaggagactatgcatgaaggcctacaacctggcggcagcgcaaaagatg

SEQ ID NO: 242081 - DNA, 103 bp, Artificial Sequence
  Synthetic Polynucleotide
taatacgactcactatagggtgcgcagctcgggtgccgtcttgtaggcctaacagaggagaaggcctatgagacggcacaacctggcggcagcgcaaaagatg

SEQ ID NO: 242082 - DNA, 103 bp, Artificial Sequence
  Synthetic Polynucleotide
taatacgactcactatagggcgcccgtggctgcgcagctcgggtgccgtcaacagaggagagacggcatgcgagctgcgaacctggcggcagcgcaaaagatg

SEQ ID NO: 242083 - DNA, 103 bp, Artificial Sequence
  Synthetic Polynucleotide
taatacgactcactatagggcgtgtggctgcgcccgtggctgcgcagctcaacagaggagagagctgatgagccacgggaacctggcggcagcgcaaaagatg

SEQ ID NO: 242084 - DNA, 103 bp, Artificial Sequence
  Synthetic Polynucleotide
taatacgactcactataggggcttctcccccgtgtggctgcgcccgtggcaacagaggagagccacgatggcagccacaaacctggcggcagcgcaaaagatg

SEQ ID NO: 242085 - DNA, 103 bp, Artificial Sequence
  Synthetic Polynucleotide
taatacgactcactatagggcacggaaagggcttctcccccgtgtggctgaacagaggagacagccaatggggggagaaaacctggcggcagcgcaaaagatg

SEQ ID NO: 242086 - DNA, 103 bp, Artificial Sequence
  Synthetic Polynucleotide
taatacgactcactataggggaacggggtttctctcggaacccacacatcaacagaggagagatgtgatggttccgagaaacctggcggcagcgcaaaagatg

SEQ ID NO: 242087 - DNA, 103 bp, Artificial Sequence
  Synthetic Polynucleotide
taatacgactcactataggggcactcggggcacggaaagggcttctccccaacagaggagaggggagatgccctttccgaacctggcggcagcgcaaaagatg

SEQ ID NO: 242088 - DNA, 103 bp, Artificial Sequence
  Synthetic Polynucleotide
taatacgactcactatagggagcggcggccgcactcggggcacggaaaggaacagaggagacctttcatggccccgagtaacctggcggcagcgcaaaagatg

SEQ ID NO: 242089 - DNA, 103 bp, Artificial Sequence
  Synthetic Polynucleotide
taatacgactcactatagggggctgcatgaagcggcggccgcactcggggaacagaggagaccccgaatgcggccgccgaacctggcggcagcgcaaaagatg

SEQ ID NO: 242090 - DNA, 103 bp, Artificial Sequence
  Synthetic Polynucleotide
taatacgactcactatagggcaggcacacgggctgcatgaagcggcggccaacagaggagaggccgcatgttcatgcagaacctggcggcagcgcaaaagatg

SEQ ID NO: 242091 - DNA, 103 bp, Artificial Sequence
  Synthetic Polynucleotide
taatacgactcactatagggggtgcacgcgcaggcacacgggctgcatgaaacagaggagatcatgcatgccgtgtgccaacctggcggcagcgcaaaagatg

SEQ ID NO: 242092 - DNA, 103 bp, Artificial Sequence
  Synthetic Polynucleotide
taatacgactcactatagggtgcgaggccaggtgcacgcgcaggcacacgaacagaggagacgtgtgatggcgcgtgcaaacctggcggcagcgcaaaagatg

SEQ ID NO: 242093 - DNA, 103 bp, Artificial Sequence
  Synthetic Polynucleotide
taatacgactcactatagggttcgccagcgtgcgaggccaggtgcacgcgaacagaggagacgcgtgatgctggcctcgaacctggcggcagcgcaaaagatg

SEQ ID NO: 242094 - DNA, 103 bp, Artificial Sequence
  Synthetic Polynucleotide
taatacgactcactatagggggaagggcagttcgccagcgtgcgaggccaaacagaggagatggcctatgacgctggcgaacctggcggcagcgcaaaagatg

SEQ ID NO: 242095 - DNA, 103 bp, Artificial Sequence
  Synthetic Polynucleotide
taatacgactcactatagggtgcgcacagcggaagggcagttcgccagcgaacagaggagacgctggatgactgcccttaacctggcggcagcgcaaaagatg

SEQ ID NO: 242096 - DNA, 103 bp, Artificial Sequence
  Synthetic Polynucleotide
taatacgactcactatagggcttcgggcagtgcgcacagcggaagggcagaacagaggagactgcccatgcgctgtgcgaacctggcggcagcgcaaaagatg

SEQ ID NO: 242097 - DNA, 103 bp, Artificial Sequence
  Synthetic Polynucleotide
taatacgactcactatagggtggccttggtgaacggggtttctctcggaaaacagaggagattccgaatgaaaccccgtaacctggcggcagcgcaaaagatg

SEQ ID NO: 242098 - DNA, 103 bp, Artificial Sequence
  Synthetic Polynucleotide
taatacgactcactatagggcgccataggccttcgggcagtgcgcacagcaacagaggagagctgtgatgactgcccgaaacctggcggcagcgcaaaagatg

SEQ ID NO: 242099 - DNA, 103 bp, Artificial Sequence
  Synthetic Polynucleotide
taatacgactcactatagggttggagagcgcgccataggccttcgggcagaacagaggagactgcccatgggcctatggaacctggcggcagcgcaaaagatg

SEQ ID NO: 242100 - DNA, 103 bp, Artificial Sequence
  Synthetic Polynucleotide
taatacgactcactataggggatcttgagcttggagagcgcgccataggcaacagaggagagcctatatggcgctctccaacctggcggcagcgcaaaagatg

SEQ ID NO: 242101 - DNA, 103 bp, Artificial Sequence
  Synthetic Polynucleotide
taatacgactcactatagggcacgctggtggatcttgagcttggagagcgaacagaggagacgctctatgagctcaagaaacctggcggcagcgcaaaagatg

SEQ ID NO: 242102 - DNA, 103 bp, Artificial Sequence
  Synthetic Polynucleotide
taatacgactcactatagggcctgtgtggccacgctggtggatcttgagcaacagaggagagctcaaatgccaccagcgaacctggcggcagcgcaaaagatg

SEQ ID NO: 242103 - DNA, 103 bp, Artificial Sequence
  Synthetic Polynucleotide
taatacgactcactatagggaggccgctcgcctgtgtggccacgctggtgaacagaggagacaccagatgggccacacaaacctggcggcagcgcaaaagatg

SEQ ID NO: 242104 - DNA, 103 bp, Artificial Sequence
  Synthetic Polynucleotide
taatacgactcactatagggcgcaggcgtaaggccgctcgcctgtgtggcaacagaggagagccacaatggcgagcggcaacctggcggcagcgcaaaagatg

SEQ ID NO: 242105 - DNA, 103 bp, Artificial Sequence
  Synthetic Polynucleotide
taatacgactcactatagggccgcagtcggcgcaggcgtaaggccgctcgaacagaggagacgagcgatgttacgcctgaacctggcggcagcgcaaaagatg

SEQ ID NO: 242106 - DNA, 103 bp, Artificial Sequence
  Synthetic Polynucleotide
taatacgactcactatagggaaagctcttgccgcagtcggcgcaggcgtaaacagaggagatacgccatggccgactgcaacctggcggcagcgcaaaagatg

SEQ ID NO: 242107 - DNA, 103 bp, Artificial Sequence
  Synthetic Polynucleotide
taatacgactcactatagggaagggtcagcaaagctcttgccgcagtcggaacagaggagaccgactatggcaagagctaacctggcggcagcgcaaaagatg

SEQ ID NO: 242108 - DNA, 103 bp, Artificial Sequence
  Synthetic Polynucleotide
taatacgactcactatagggtccacttccatggccttggtgaacggggttaacagaggagaaaccccatgcaccaaggcaacctggcggcagcgcaaaagatg

SEQ ID NO: 242109 - DNA, 103 bp, Artificial Sequence
  Synthetic Polynucleotide
taatacgactcactatagggcggaacactgaagggtcagcaaagctcttgaacagaggagacaagagatgtgctgacccaacctggcggcagcgcaaaagatg

SEQ ID NO: 242110 - DNA, 103 bp, Artificial Sequence
  Synthetic Polynucleotide
taatacgactcactatagggccggtgcttgcggaacactgaagggtcagcaacagaggagagctgacatgtcagtgttcaacctggcggcagcgcaaaagatg

SEQ ID NO: 242111 - DNA, 103 bp, Artificial Sequence
  Synthetic Polynucleotide
taatacgactcactatagggcgtgagtacgccggtgcttgcggaacactgaacagaggagacagtgtatggcaagcaccaacctggcggcagcgcaaaagatg

SEQ ID NO: 242112 - DNA, 103 bp, Artificial Sequence
  Synthetic Polynucleotide
taatacgactcactatagggcgcaggccagcgtgagtacgccggtgcttgaacagaggagacaagcaatggcgtactcaaacctggcggcagcgcaaaagatg

SEQ ID NO: 242113 - DNA, 103 bp, Artificial Sequence
  Synthetic Polynucleotide
taatacgactcactataggggctgtagggccgcaggccagcgtgagtacgaacagaggagacgtactatggctggcctgaacctggcggcagcgcaaaagatg

SEQ ID NO: 242114 - DNA, 103 bp, Artificial Sequence
  Synthetic Polynucleotide
taatacgactcactatagggaacgctcacagctgtagggccgcaggccagaacagaggagactggccatgggccctacaaacctggcggcagcgcaaaagatg

SEQ ID NO: 242115 - DNA, 103 bp, Artificial Sequence
  Synthetic Polynucleotide
taatacgactcactataggggctttgccgcaacgctcacagctgtagggcaacagaggagagccctaatgctgtgagcgaacctggcggcagcgcaaaagatg

SEQ ID NO: 242116 - DNA, 103 bp, Artificial Sequence
  Synthetic Polynucleotide
taatacgactcactatagggctccgcataggctttgccgcaacgctcacaaacagaggagatgtgagatgtgcggcaaaaacctggcggcagcgcaaaagatg

SEQ ID NO: 242117 - DNA, 103 bp, Artificial Sequence
  Synthetic Polynucleotide
taatacgactcactatagggggtccttgagctccgcataggctttgccgcaacagaggagagcggcaatgcctatgcggaacctggcggcagcgcaaaagatg

SEQ ID NO: 242118 - DNA, 103 bp, Artificial Sequence
  Synthetic Polynucleotide
taatacgactcactatagggtggttgcggaggtccttgagctccgcatagaacagaggagactatgcatggctcaaggaaacctggcggcagcgcaaaagatg

SEQ ID NO: 242119 - DNA, 103 bp, Artificial Sequence
  Synthetic Polynucleotide
taatacgactcactatagggctctgcagcctccacttccatggccttggtaacagaggagaaccaagatgatggaagtgaacctggcggcagcgcaaaagatg

SEQ ID NO: 242120 - DNA, 103 bp, Artificial Sequence
  Synthetic Polynucleotide
taatacgactcactatagggggaccgctcatggttgcggaggtccttgagaacagaggagactcaagatgctccgcaacaacctggcggcagcgcaaaagatg

SEQ ID NO: 242121 - DNA, 103 bp, Artificial Sequence
  Synthetic Polynucleotide
taatacgactcactatagggcgccggtgtgggaccgctcatggttgcggaaacagaggagatccgcaatgatgagcggtaacctggcggcagcgcaaaagatg

SEQ ID NO: 242122 - DNA, 103 bp, Artificial Sequence
  Synthetic Polynucleotide
taatacgactcactatagggaaggggcgctcgccggtgtgggaccgctcaaacagaggagatgagcgatgccacaccggaacctggcggcagcgcaaaagatg

SEQ ID NO: 242123 - DNA, 103 bp, Artificial Sequence
  Synthetic Polynucleotide
taatacgactcactatagggggagcagaggaaggggcgctcgccggtgtgaacagaggagacacaccatggagcgccccaacctggcggcagcgcaaaagatg

SEQ ID NO: 242124 - DNA, 103 bp, Artificial Sequence
  Synthetic Polynucleotide
taatacgactcactatagggtcccgcactcggagcagaggaaggggcgctaacagaggagaagcgccatgtcctctgctaacctggcggcagcgcaaaagatg

SEQ ID NO: 242125 - DNA, 103 bp, Artificial Sequence
  Synthetic Polynucleotide
taatacgactcactataggggagaagctcttcccgcactcggagcagaggaacagaggagacctctgatgcgagtgcggaacctggcggcagcgcaaaagatg

SEQ ID NO: 242126 - DNA, 103 bp, Artificial Sequence
  Synthetic Polynucleotide
taatacgactcactatagggggatgagcgggagaagctcttcccgcactcaacagaggagagagtgcatgaagagcttcaacctggcggcagcgcaaaagatg

SEQ ID NO: 242127 - DNA, 103 bp, Artificial Sequence
  Synthetic Polynucleotide
taatacgactcactatagggacgtgagcgaggatgagcgggagaagctctaacagaggagaagagctatgcccgctcataacctggcggcagcgcaaaagatg

SEQ ID NO: 242128 - DNA, 103 bp, Artificial Sequence
  Synthetic Polynucleotide
taatacgactcactatagggcgctggtggcacgtgagcgaggatgagcggaacagaggagaccgctcatgctcgctcacaacctggcggcagcgcaaaagatg

SEQ ID NO: 242129 - DNA, 103 bp, Artificial Sequence
  Synthetic Polynucleotide
taatacgactcactatagggcgcgtggatgcgctggtggcacgtgagcgaaacagaggagatcgctcatgtgccaccagaacctggcggcagcgcaaaagatg

SEQ ID NO: 242130 - DNA, 103 bp, Artificial Sequence
  Synthetic Polynucleotide
taatacgactcactataggggggaccgggcctctgcagcctccacttccaaacagaggagatggaagatgaggctgcagaacctggcggcagcgcaaaagatg

SEQ ID NO: 242131 - DNA, 103 bp, Artificial Sequence
  Synthetic Polynucleotide
taatacgactcactataggggcttctgtgccgcgtggatgcgctggtggcaacagaggagagccaccatggcatccacgaacctggcggcagcgcaaaagatg

SEQ ID NO: 242132 - DNA, 103 bp, Artificial Sequence
  Synthetic Polynucleotide
taatacgactcactatagggcagcggtagggcttctgtgccgcgtggatgaacagaggagacatccaatgggcacagaaaacctggcggcagcgcaaaagatg

SEQ ID NO: 242133 - DNA, 103 bp, Artificial Sequence
  Synthetic Polynucleotide
taatacgactcactataggggcaggccgggcagcggtagggcttctgtgcaacagaggagagcacagatgccctaccgcaacctggcggcagcgcaaaagatg

SEQ ID NO: 242134 - DNA, 103 bp, Artificial Sequence
  Synthetic Polynucleotide
taatacgactcactatagggagcccttgccgcaggccgggcagcggtaggaacagaggagacctaccatggcccggcctaacctggcggcagcgcaaaagatg

SEQ ID NO: 242135 - DNA, 103 bp, Artificial Sequence
  Synthetic Polynucleotide
taatacgactcactatagggagctgcgtgaagcccttgccgcaggccgggaacagaggagacccggcatgcggcaagggaacctggcggcagcgcaaaagatg

SEQ ID NO: 242136 - DNA, 103 bp, Artificial Sequence
  Synthetic Polynucleotide
taatacgactcactataggggtaggaactgagctgcgtgaagcccttgccaacagaggagaggcaagatgttcacgcagaacctggcggcagcgcaaaagatg

SEQ ID NO: 242137 - DNA, 103 bp, Artificial Sequence
  Synthetic Polynucleotide
taatacgactcactatagggcgtggctctggtaggaactgagctgcgtgaaacagaggagatcacgcatgtcagttcctaacctggcggcagcgcaaaagatg

SEQ ID NO: 242138 - DNA, 103 bp, Artificial Sequence
  Synthetic Polynucleotide
taatacgactcactatagggtgcgtgcgctcgtggctctggtaggaactgaacagaggagacagttcatgccagagccaaacctggcggcagcgcaaaagatg

SEQ ID NO: 242139 - DNA, 103 bp, Artificial Sequence
  Synthetic Polynucleotide
taatacgactcactatagggctcccccgagtgcgtgcgctcgtggctctgaacagaggagacagagcatggagcgcacgaacctggcggcagcgcaaaagatg

SEQ ID NO: 242140 - DNA, 103 bp, Artificial Sequence
  Synthetic Polynucleotide
taatacgactcactatagggggaagggcttctcccccgagtgcgtgcgctaacagaggagaagcgcaatgactcgggggaacctggcggcagcgcaaaagatg

SEQ ID NO: 242141 - DNA, 103 bp, Artificial Sequence
  Synthetic Polynucleotide
taatacgactcactatagggccgggggctggggaccgggcctctgcagccaacagaggagaggctgcatgggcccggtcaacctggcggcagcgcaaaagatg

SEQ ID NO: 242142 - DNA, 103 bp, Artificial Sequence
  Synthetic Polynucleotide
taatacgactcactatagggcgcgggcacaggaagggcttctcccccgagaacagaggagactcgggatggaagcccttaacctggcggcagcgcaaaagatg

SEQ ID NO: 242143 - DNA, 103 bp, Artificial Sequence
  Synthetic Polynucleotide
taatacgactcactataggggcggccgcagcgcgggcacaggaagggcttaacagaggagaaagcccatgctgtgcccgaacctggcggcagcgcaaaagatg

SEQ ID NO: 242144 - DNA, 103 bp, Artificial Sequence
  Synthetic Polynucleotide
taatacgactcactatagggcggagaacatgcggccgcagcgcgggcacaaacagaggagatgtgccatggctgcggccaacctggcggcagcgcaaaagatg

SEQ ID NO: 242145 - DNA, 103 bp, Artificial Sequence
  Synthetic Polynucleotide
taatacgactcactatagggctcgaggggtcggagaacatgcggccgcagaacagaggagactgcggatgcatgttctcaacctggcggcagcgcaaaagatg

SEQ ID NO: 242146 - DNA, 103 bp, Artificial Sequence
  Synthetic Polynucleotide
taatacgactcactataggggcgacggaagctcgaggggtcggagaacataacagaggagaatgttcatggacccctcgaacctggcggcagcgcaaaagatg

SEQ ID NO: 242147 - DNA, 103 bp, Artificial Sequence
  Synthetic Polynucleotide
taatacgactcactatagggcgcgctggtggcgacggaagctcgaggggtaacagaggagaacccctatggcttccgtcaacctggcggcagcgcaaaagatg

SEQ ID NO: 242148 - DNA, 103 bp, Artificial Sequence
  Synthetic Polynucleotide
taatacgactcactatagggccttcatgggcgcgctggtggcgacggaagaacagaggagacttccgatgccaccagcgaacctggcggcagcgcaaaagatg

SEQ ID NO: 242149 - DNA, 103 bp, Artificial Sequence
  Synthetic Polynucleotide
taatacgactcactatagggtggcttcaccccttcatgggcgcgctggtgaacagaggagacaccagatggcccatgaaaacctggcggcagcgcaaaagatg

SEQ ID NO: 242150 - DNA, 103 bp, Artificial Sequence
  Synthetic Polynucleotide
taatacgactcactatagggcgcagtggtatggcttcaccccttcatgggaacagaggagacccatgatggggtgaagcaacctggcggcagcgcaaaagatg

SEQ ID NO: 242151 - DNA, 103 bp, Artificial Sequence
  Synthetic Polynucleotide
taatacgactcactatagggccgcacttctcgcagtggtatggcttcaccaacagaggagaggtgaaatgataccactgaacctggcggcagcgcaaaagatg

SEQ ID NO: 242152 - DNA, 103 bp, Artificial Sequence
  Synthetic Polynucleotide
taatacgactcactatagggagcagagtgggttggtgaacagagtgacataacagaggagaatgtcaatgtgttcaccaaacctggcggcagcgcaaaagatg

SEQ ID NO: 242153 - DNA, 103 bp, Artificial Sequence
  Synthetic Polynucleotide
taatacgactcactatagggtggactctgctccttctcactgcccatctcaacagaggagagagatgatgagtgagaagaacctggcggcagcgcaaaagatg

SEQ ID NO: 242154 - DNA, 103 bp, Artificial Sequence
  Synthetic Polynucleotide
taatacgactcactatagggggtgtggttctggactctgctccttctcacaacagaggagagtgagaatgagcagagtcaacctggcggcagcgcaaaagatg

SEQ ID NO: 242155 - DNA, 103 bp, Artificial Sequence
  Synthetic Polynucleotide
taatacgactcactatagggtcctcaggcaggtgtggttctggactctgcaacagaggagagcagagatgagaaccacaaacctggcggcagcgcaaaagatg

SEQ ID NO: 242156 - DNA, 103 bp, Artificial Sequence
  Synthetic Polynucleotide
taatacgactcactatagggcccttccccttcctcaggcaggtgtggttcaacagaggagagaaccaatgctgcctgagaacctggcggcagcgcaaaagatg

SEQ ID NO: 242157 - DNA, 103 bp, Artificial Sequence
  Synthetic Polynucleotide
taatacgactcactatagggaaggcttacccccttccccttcctcaggcaaacagaggagatgcctgatgaaggggaagaacctggcggcagcgcaaaagatg

SEQ ID NO: 242158 - DNA, 103 bp, Artificial Sequence
  Synthetic Polynucleotide
taatacgactcactatagggtccactctccaaggcttacccccttcccctaacagaggagaaggggaatggggtaagccaacctggcggcagcgcaaaagatg

SEQ ID NO: 242159 - DNA, 103 bp, Artificial Sequence
  Synthetic Polynucleotide
taatacgactcactatagggctctgagtcatccactctccaaggcttaccaacagaggagaggtaagatgtggagagtgaacctggcggcagcgcaaaagatg

SEQ ID NO: 242160 - DNA, 103 bp, Artificial Sequence
  Synthetic Polynucleotide
taatacgactcactatagggtccaagaaccctctgagtcatccactctccaacagaggagaggagagatgatgactcagaacctggcggcagcgcaaaagatg

SEQ ID NO: 242161 - DNA, 103 bp, Artificial Sequence
  Synthetic Polynucleotide
taatacgactcactatagggccaggtgggatccaagaaccctctgagtcaaacagaggagatgactcatggggttcttgaacctggcggcagcgcaaaagatg

SEQ ID NO: 242162 - DNA, 103 bp, Artificial Sequence
  Synthetic Polynucleotide
taatacgactcactatagggctccttctccccaggtgggatccaagaaccaacagaggagaggttctatgatcccacctaacctggcggcagcgcaaaagatg

SEQ ID NO: 242163 - DNA, 103 bp, Artificial Sequence
  Synthetic Polynucleotide
taatacgactcactatagggacgacatttcagcagagtgggttggtgaacaacagaggagagttcacatgcccactctgaacctggcggcagcgcaaaagatg

SEQ ID NO: 242164 - DNA, 103 bp, Artificial Sequence
  Synthetic Polynucleotide
taatacgactcactatagggcttgcccatgctccttctccccaggtgggaaacagaggagatcccacatggggagaaggaacctggcggcagcgcaaaagatg

SEQ ID NO: 242165 - DNA, 103 bp, Artificial Sequence
  Synthetic Polynucleotide
taatacgactcactataggggacaggctctcttgcccatgctccttctccaacagaggagaggagaaatggcatgggcaaacctggcggcagcgcaaaagatg

SEQ ID NO: 242166 - DNA, 103 bp, Artificial Sequence
  Synthetic Polynucleotide
taatacgactcactatagggcagttcatccgacaggctctcttgcccatgaacagaggagacatgggatggagagcctgaacctggcggcagcgcaaaagatg

SEQ ID NO: 242167 - DNA, 103 bp, Artificial Sequence
  Synthetic Polynucleotide
taatacgactcactataggggagtttcttgcagttcatccgacaggctctaacagaggagaagagccatgcggatgaacaacctggcggcagcgcaaaagatg

SEQ ID NO: 242168 - DNA, 103 bp, Artificial Sequence
  Synthetic Polynucleotide
taatacgactcactatagggttttttggatgagtttcttgcagttcatccaacagaggagaggatgaatggcaagaaacaacctggcggcagcgcaaaagatg

SEQ ID NO: 242169 - DNA, 103 bp, Artificial Sequence
  Synthetic Polynucleotide
taatacgactcactatagggctgccatggcttttttggatgagtttcttgaacagaggagacaagaaatgcatccaaaaaacctggcggcagcgcaaaagatg

SEQ ID NO: 242170 - DNA, 103 bp, Artificial Sequence
  Synthetic Polynucleotide
taatacgactcactatagggcagtgactttctgccatggcttttttggataacagaggagaatccaaatgagccatggcaacctggcggcagcgcaaaagatg

SEQ ID NO: 242171 - DNA, 103 bp, Artificial Sequence
  Synthetic Polynucleotide
taatacgactcactatagggcgagcccggacagtgactttctgccatggcaacagaggagagccatgatggaaagtcacaacctggcggcagcgcaaaagatg

SEQ ID NO: 242172 - DNA, 103 bp, Artificial Sequence
  Synthetic Polynucleotide
taatacgactcactatagggccctagctctcgagcccggacagtgactttaacagaggagaaaagtcatggtccgggctaacctggcggcagcgcaaaagatg

SEQ ID NO: 242173 - DNA, 103 bp, Artificial Sequence
  Synthetic Polynucleotide
taatacgactcactatagggcaatggggtcccctagctctcgagcccggaaacagaggagatccgggatggagagctagaacctggcggcagcgcaaaagatg

SEQ ID NO: 242174 - DNA, 103 bp, Artificial Sequence
  Synthetic Polynucleotide
taatacgactcactatagggtgaagaaataacgacatttcagcagagtggaacagaggagaccactcatgtgaaatgtcaacctggcggcagcgcaaaagatg

SEQ ID NO: 242175 - DNA, 103 bp, Artificial Sequence
  Synthetic Polynucleotide
taatacgactcactatagggcttggatgagcaatggggtcccctagctctaacagaggagaagagctatgggaccccataacctggcggcagcgcaaaagatg

SEQ ID NO: 242176 - DNA, 103 bp, Artificial Sequence
  Synthetic Polynucleotide
taatacgactcactatagggtgcctcatgccttggatgagcaatggggtcaacagaggagagaccccatggctcatccaaacctggcggcagcgcaaaagatg

SEQ ID NO: 242177 - DNA, 103 bp, Artificial Sequence
  Synthetic Polynucleotide
taatacgactcactataggggcttctcatctgcctcatgccttggatgagaacagaggagactcatcatgggcatgaggaacctggcggcagcgcaaaagatg

SEQ ID NO: 242178 - DNA, 103 bp, Artificial Sequence
  Synthetic Polynucleotide
taatacgactcactatagggcatataaagggcttctcatctgcctcatgcaacagaggagagcatgaatgagatgagaaaacctggcggcagcgcaaaagatg

SEQ ID NO: 242179 - DNA, 103 bp, Artificial Sequence
  Synthetic Polynucleotide
taatacgactcactatagggacactgggcacatataaagggcttctcatcaacagaggagagatgagatgccctttataaacctggcggcagcgcaaaagatg

SEQ ID NO: 242180 - DNA, 103 bp, Artificial Sequence
  Synthetic Polynucleotide
taatacgactcactatagggaggttttgccacactgggcacatataaaggaacagaggagacctttaatggtgcccagtaacctggcggcagcgcaaaagatg

SEQ ID NO: 242181 - DNA, 103 bp, Artificial Sequence
  Synthetic Polynucleotide
taatacgactcactataggggtattattgaaggttttgccacactgggcaaacagaggagatgcccaatgtggcaaaacaacctggcggcagcgcaaaagatg

SEQ ID NO: 242182 - DNA, 103 bp, Artificial Sequence
  Synthetic Polynucleotide
taatacgactcactatagggcaggttggaggtattattgaaggttttgccaacagaggagaggcaaaatgttcaataataacctggcggcagcgcaaaagatg

SEQ ID NO: 242183 - DNA, 103 bp, Artificial Sequence
  Synthetic Polynucleotide
taatacgactcactatagggggtgtgttctcaggttggaggtattattgaaacagaggagatcaataatgcctccaaccaacctggcggcagcgcaaaagatg

SEQ ID NO: 242184 - DNA, 103 bp, Artificial Sequence
  Synthetic Polynucleotide
taatacgactcactatagggtggatccgctggtgtgttctcaggttggagaacagaggagactccaaatggagaacacaaacctggcggcagcgcaaaagatg

SEQ ID NO: 242185 - DNA, 103 bp, Artificial Sequence
  Synthetic Polynucleotide
taatacgactcactatagggctccgggccttgaagaaataacgacatttcaacagaggagagaaatgatgttatttcttaacctggcggcagcgcaaaagatg

SEQ ID NO: 242186 - DNA, 103 bp, Artificial Sequence
  Synthetic Polynucleotide
taatacgactcactatagggctcaccagtgtggatccgctggtgtgttctaacagaggagaagaacaatgcagcggatcaacctggcggcagcgcaaaagatg

SEQ ID NO: 242187 - DNA, 103 bp, Artificial Sequence
  Synthetic Polynucleotide
taatacgactcactatagggtgtaaggcttctcaccagtgtggatccgctaacagaggagaagcggaatgacactggtgaacctggcggcagcgcaaaagatg

SEQ ID NO: 242188 - DNA, 103 bp, Artificial Sequence
  Synthetic Polynucleotide
taatacgactcactatagggtcagaacacttgtaaggcttctcaccagtgaacagaggagacactggatggaagccttaaacctggcggcagcgcaaaagatg

SEQ ID NO: 242189 - DNA, 103 bp, Artificial Sequence
  Synthetic Polynucleotide
taatacgactcactatagggcttgccacattcagaacacttgtaaggcttaacagaggagaaagcctatgaagtgttctaacctggcggcagcgcaaaagatg

SEQ ID NO: 242190 - DNA, 103 bp, Artificial Sequence
  Synthetic Polynucleotide
taatacgactcactatagggtcgagaagctcttgccacattcagaacactaacagaggagaagtgttatgaatgtggcaaacctggcggcagcgcaaaagatg

SEQ ID NO: 242191 - DNA, 103 bp, Artificial Sequence
  Synthetic Polynucleotide
taatacgactcactatagggttggagcttctcgagaagctcttgccacataacagaggagaatgtggatggagcttctcaacctggcggcagcgcaaaagatg

SEQ ID NO: 242192 - DNA, 103 bp, Artificial Sequence
  Synthetic Polynucleotide
taatacgactcactatagggccggatgcggttggagcttctcgagaagctaacagaggagaagcttcatgagaagctccaacctggcggcagcgcaaaagatg

SEQ ID NO: 242193 - DNA, 103 bp, Artificial Sequence
  Synthetic Polynucleotide
taatacgactcactatagggtccgctcgtgccggatgcggttggagcttcaacagaggagagaagctatgaccgcatccaacctggcggcagcgcaaaagatg

SEQ ID NO: 242194 - DNA, 103 bp, Artificial Sequence
  Synthetic Polynucleotide
taatacgactcactatagggtccaggtggatccgctcgtgccggatgcggaacagaggagaccgcatatggcacgagcgaacctggcggcagcgcaaaagatg

SEQ ID NO: 242195 - DNA, 103 bp, Artificial Sequence
  Synthetic Polynucleotide
taatacgactcactataggggtgtttctcttccaggtggatccgctcgtgaacagaggagacacgagatgatccacctgaacctggcggcagcgcaaaagatg

SEQ ID NO: 242196 - DNA, 103 bp, Artificial Sequence
  Synthetic Polynucleotide
taatacgactcactataggggtagcatttcctccgggccttgaagaaataaacagaggagatatttcatgaaggcccggaacctggcggcagcgcaaaagatg

SEQ ID NO: 242197 - DNA, 103 bp, Artificial Sequence
  Synthetic Polynucleotide
taatacgactcactatagggggcatttgtagtgtttctcttccaggtggaaacagaggagatccaccatgaagagaaacaacctggcggcagcgcaaaagatg

SEQ ID NO: 242198 - DNA, 103 bp, Artificial Sequence
  Synthetic Polynucleotide
taatacgactcactatagggtggcacttggggcatttgtagtgtttctctaacagaggagaagagaaatgctacaaatgaacctggcggcagcgcaaaagatg

SEQ ID NO: 242199 - DNA, 103 bp, Artificial Sequence
  Synthetic Polynucleotide
taatacgactcactatagggaaagctctcctggcacttggggcatttgtaaacagaggagatacaaaatgcccaagtgcaacctggcggcagcgcaaaagatg

SEQ ID NO: 242200 - DNA, 103 bp, Artificial Sequence
  Synthetic Polynucleotide
taatacgactcactatagggagcgccgccgaaagctctcctggcacttggaacagaggagaccaagtatgaggagagctaacctggcggcagcgcaaaagatg

SEQ ID NO: 242201 - DNA, 103 bp, Artificial Sequence
  Synthetic Polynucleotide
taatacgactcactataggggtgaggtctgagcgccgccgaaagctctccaacagaggagaggagagatgtcggcggcgaacctggcggcagcgcaaaagatg

SEQ ID NO: 242202 - DNA, 103 bp, Artificial Sequence
  Synthetic Polynucleotide
taatacgactcactatagggctggtgcgtggtgaggtctgagcgccgccgaacagaggagacggcggatgtcagacctcaacctggcggcagcgcaaaagatg

SEQ ID NO: 242203 - DNA, 103 bp, Artificial Sequence
  Synthetic Polynucleotide
taatacgactcactatagggggtgatcttgctggtgcgtggtgaggtctgaacagaggagacagaccatgccacgcaccaacctggcggcagcgcaaaagatg

SEQ ID NO: 242204 - DNA, 103 bp, Artificial Sequence
  Synthetic Polynucleotide
taatacgactcactatagggcgcttgcctaggtgatcttgctggtgcgtgaacagaggagacacgcaatggcaagatcaaacctggcggcagcgcaaaagatg

SEQ ID NO: 242205 - DNA, 103 bp, Artificial Sequence
  Synthetic Polynucleotide
taatacgactcactataggggcggtatggccgcttgcctaggtgatcttgaacagaggagacaagatatgctaggcaagaacctggcggcagcgcaaaagatg

SEQ ID NO: 242206 - DNA, 103 bp, Artificial Sequence
  Synthetic Polynucleotide
taatacgactcactatagggagatgtcacagcggtatggccgcttgcctaaacagaggagataggcaatgggccataccaacctggcggcagcgcaaaagatg

SEQ ID NO: 242207 - DNA, 103 bp, Artificial Sequence
  Synthetic Polynucleotide
taatacgactcactataggggatgagagtggtagcatttcctccgggcctaacagaggagaaggcccatgggaaatgctaacctggcggcagcgcaaaagatg

SEQ ID NO: 242208 - DNA, 103 bp, Artificial Sequence
  Synthetic Polynucleotide
taatacgactcactatagggctcttgccacagatgtcacagcggtatggcaacagaggagagccataatgctgtgacataacctggcggcagcgcaaaagatg

SEQ ID NO: 242209 - DNA, 103 bp, Artificial Sequence
  Synthetic Polynucleotide
taatacgactcactatagggctggctgaagctcttgccacagatgtcacaaacagaggagatgtgacatgtgtggcaagaacctggcggcagcgcaaaagatg

SEQ ID NO: 242210 - DNA, 103 bp, Artificial Sequence
  Synthetic Polynucleotide
taatacgactcactataggggcgtggcactctggctgaagctcttgccacaacagaggagagtggcaatggcttcagccaacctggcggcagcgcaaaagatg

SEQ ID NO: 242211 - DNA, 103 bp, Artificial Sequence
  Synthetic Polynucleotide
taatacgactcactatagggtgcacagctagcgtggcactctggctgaagaacagaggagacttcagatggagtgccacaacctggcggcagcgcaaaagatg

SEQ ID NO: 242212 - DNA, 103 bp, Artificial Sequence
  Synthetic Polynucleotide
taatacgactcactatagggggtccggtgatgcacagctagcgtggcactaacagaggagaagtgccatgctagctgtgaacctggcggcagcgcaaaagatg

SEQ ID NO: 242213 - DNA, 103 bp, Artificial Sequence
  Synthetic Polynucleotide
taatacgactcactataggggctccaggtgggtccggtgatgcacagctaaacagaggagatagctgatgatcaccggaaacctggcggcagcgcaaaagatg

SEQ ID NO: 242214 - DNA, 103 bp, Artificial Sequence
  Synthetic Polynucleotide
taatacgactcactatagggtagggtgctggctccaggtgggtccggtgaaacagaggagatcaccgatgccacctggaaacctggcggcagcgcaaaagatg

SEQ ID NO: 242215 - DNA, 103 bp, Artificial Sequence
  Synthetic Polynucleotide
taatacgactcactatagggacagcagatgtagggtgctggctccaggtgaacagaggagacacctgatgccagcacccaacctggcggcagcgcaaaagatg

SEQ ID NO: 242216 - DNA, 103 bp, Artificial Sequence
  Synthetic Polynucleotide
taatacgactcactatagggtcccacactcacagcagatgtagggtgctgaacagaggagacagcacatgacatctgctaacctggcggcagcgcaaaagatg

SEQ ID NO: 242217 - DNA, 103 bp, Artificial Sequence
  Synthetic Polynucleotide
taatacgactcactatagggctgaagctcttcccacactcacagcagatgaacagaggagacatctgatgtgagtgtggaacctggcggcagcgcaaaagatg

SEQ ID NO: 242218 - DNA, 103 bp, Artificial Sequence
  Synthetic Polynucleotide
taatacgactcactatagggtgaaccctctgatgagagtggtagcatttcaacagaggagagaaatgatgccactctcaaacctggcggcagcgcaaaagatg

SEQ ID NO: 242219 - DNA, 103 bp, Artificial Sequence
  Synthetic Polynucleotide
taatacgactcactatagggggagctgttgctgaagctcttcccacactcaacagaggagagagtgtatgaagagcttcaacctggcggcagcgcaaaagatg

SEQ ID NO: 242220 - DNA, 103 bp, Artificial Sequence
  Synthetic Polynucleotide
taatacgactcactatagggcgccaaagctggagctgttgctgaagctctaacagaggagaagagctatggcaacagctaacctggcggcagcgcaaaagatg

SEQ ID NO: 242221 - DNA, 103 bp, Artificial Sequence
  Synthetic Polynucleotide
taatacgactcactatagggcggtgatgcacgccaaagctggagctgttgaacagaggagacaacagatgcagctttggaacctggcggcagcgcaaaagatg

SEQ ID NO: 242222 - DNA, 103 bp, Artificial Sequence
  Synthetic Polynucleotide
taatacgactcactatagggtgtgtgggtgcggtgatgcacgccaaagctaacagaggagaagctttatggtgcatcacaacctggcggcagcgcaaaagatg

SEQ ID NO: 242223 - DNA, 103 bp, Artificial Sequence
  Synthetic Polynucleotide
taatacgactcactataggggtctctcacctgtgtgggtgcggtgatgcaaacagaggagatgcatcatggcacccacaaacctggcggcagcgcaaaagatg

SEQ ID NO: 242224 - DNA, 103 bp, Artificial Sequence
  Synthetic Polynucleotide
taatacgactcactatagggcactcataaggtctctcacctgtgtgggtgaacagaggagacacccaatgaggtgagagaacctggcggcagcgcaaaagatg

SEQ ID NO: 242225 - DNA, 103 bp, Artificial Sequence
  Synthetic Polynucleotide
taatacgactcactatagggacactcagtgcactcataaggtctctcaccaacagaggagaggtgagatgccttatgagaacctggcggcagcgcaaaagatg

SEQ ID NO: 242226 - DNA, 103 bp, Artificial Sequence
  Synthetic Polynucleotide
taatacgactcactatagggaggtccgcccacactcagtgcactcataagaacagaggagacttatgatggcactgagtaacctggcggcagcgcaaaagatg

SEQ ID NO: 242227 - DNA, 103 bp, Artificial Sequence
  Synthetic Polynucleotide
taatacgactcactatagggatatcgctgaaggtccgcccacactcagtgaacagaggagacactgaatgtgggcggacaacctggcggcagcgcaaaagatg

SEQ ID NO: 242228 - DNA, 103 bp, Artificial Sequence
  Synthetic Polynucleotide
taatacgactcactatagggaaagttggagatatcgctgaaggtccgcccaacagaggagagggcggatgttcagcgataacctggcggcagcgcaaaagatg

SEQ ID NO: 242229 - DNA, 103 bp, Artificial Sequence
  Synthetic Polynucleotide
taatacgactcactatagggtgcccatctctgaaccctctgatgagagtgaacagaggagacactctatgcagagggttaacctggcggcagcgcaaaagatg

SEQ ID NO: 242230 - DNA, 103 bp, Artificial Sequence
  Synthetic Polynucleotide
taatacgactcactatagggggtgtgctccaaagttggagatatcgctgaaacagaggagatcagcgatgtctccaactaacctggcggcagcgcaaaagatg

SEQ ID NO: 242231 - DNA, 103 bp, Artificial Sequence
  Synthetic Polynucleotide
taatacgactcactatagggtgggtccgctggtgtgctccaaagttggagaacagaggagactccaaatgtggagcacaaacctggcggcagcgcaaaagatg

SEQ ID NO: 242232 - DNA, 103 bp, Artificial Sequence
  Synthetic Polynucleotide
taatacgactcactatagggctcccctctgtgggtccgctggtgtgctccaacagaggagaggagcaatgcagcggaccaacctggcggcagcgcaaaagatg

SEQ ID NO: 242233 - DNA, 103 bp, Artificial Sequence
  Synthetic Polynucleotide
taatacgactcactatagggggtagggcttctcccctctgtgggtccgctaacagaggagaagcggaatgacagaggggaacctggcggcagcgcaaaagatg

SEQ ID NO: 242234 - DNA, 103 bp, Artificial Sequence
  Synthetic Polynucleotide
taatacgactcactatagggacagtgcaccggtagggcttctcccctctgaacagaggagacagaggatggaagccctaaacctggcggcagcgcaaaagatg

SEQ ID NO: 242235 - DNA, 103 bp, Artificial Sequence
  Synthetic Polynucleotide
taatacgactcactatagggtttcccacacacagtgcaccggtagggcttaacagaggagaaagcccatgcggtgcactaacctggcggcagcgcaaaagatg

SEQ ID NO: 242236 - DNA, 103 bp, Artificial Sequence
  Synthetic Polynucleotide
taatacgactcactataggggggagaagtgtttcccacacacagtgcaccaacagaggagaggtgcaatgtgtgtgggaaacctggcggcagcgcaaaagatg

SEQ ID NO: 242237 - DNA, 103 bp, Artificial Sequence
  Synthetic Polynucleotide
taatacgactcactatagggttcgagctccgggagaagtgtttcccacacaacagaggagagtgtggatgacacttctcaacctggcggcagcgcaaaagatg

SEQ ID NO: 242238 - DNA, 103 bp, Artificial Sequence
  Synthetic Polynucleotide
taatacgactcactataggggcggatgagattcgagctccgggagaagtgaacagaggagacacttcatgcggagctcgaacctggcggcagcgcaaaagatg

SEQ ID NO: 242239 - DNA, 103 bp, Artificial Sequence
  Synthetic Polynucleotide
taatacgactcactatagggttttctggtggcggatgagattcgagctccaacagaggagaggagctatgatctcatccaacctggcggcagcgcaaaagatg

SEQ ID NO: 242240 - DNA, 103 bp, Artificial Sequence
  Synthetic Polynucleotide
taatacgactcactatagggtccttctcactgcccatctctgaaccctctaacagaggagaagagggatgagagatgggaacctggcggcagcgcaaaagatg

SEQ ID NO: 242241 - DNA, 103 bp, Artificial Sequence
  Synthetic Polynucleotide
taatacgactcactatagggcccaagtgagttttctggtggcggatgagaaacagaggagatctcatatgccaccagaaaacctggcggcagcgcaaaagatg

SEQ ID NO: 242242 - DNA, 103 bp, Artificial Sequence
  Synthetic Polynucleotide
taatacgactcactatagggagcctgttcgcccaagtgagttttctggtgaacagaggagacaccagatgactcacttgaacctggcggcagcgcaaaagatg

SEQ ID NO: 242243 - DNA, 103 bp, Artificial Sequence
  Synthetic Polynucleotide
taatacgactcactatagggaatctttcccagcctgttcgcccaagtgagaacagaggagactcactatggcgaacaggaacctggcggcagcgcaaaagatg

SEQ ID NO: 242244 - DNA, 103 bp, Artificial Sequence
  Synthetic Polynucleotide
taatacgactcactatagggggacacgtccaccgccggggaggaagccataacagaggagaatggctatgtccccggcgaacctggcggcagcgcaaaagatg

SEQ ID NO: 242245 - DNA, 103 bp, Artificial Sequence
  Synthetic Polynucleotide
taatacgactcactataggggaggcaccactgctccatgtggccgcccagaacagaggagactgggcatgcacatggagaacctggcggcagcgcaaaagatg

SEQ ID NO: 242246 - DNA, 103 bp, Artificial Sequence
  Synthetic Polynucleotide
taatacgactcactatagggggagaagatccttccacagccagggaagtcaacagaggagagacttcatgggctgtggaaacctggcggcagcgcaaaagatg

SEQ ID NO: 242247 - DNA, 103 bp, Artificial Sequence
  Synthetic Polynucleotide
taatacgactcactatagggactgccggttggagaagatccttccacagcaacagaggagagctgtgatgggatcttctaacctggcggcagcgcaaaagatg

SEQ ID NO: 242248 - DNA, 103 bp, Artificial Sequence
  Synthetic Polynucleotide
taatacgactcactatagggtgattcaaatactgccggttggagaagatcaacagaggagagatcttatgcaaccggcaaacctggcggcagcgcaaaagatg

SEQ ID NO: 242249 - DNA, 103 bp, Artificial Sequence
  Synthetic Polynucleotide
taatacgactcactatagggctttttgtggtgattcaaatactgccggttaacagaggagaaaccggatgtatttgaataacctggcggcagcgcaaaagatg

SEQ ID NO: 242250 - DNA, 103 bp, Artificial Sequence
  Synthetic Polynucleotide
taatacgactcactatagggtgtgctggtactttttgtggtgattcaaataacagaggagaatttgaatgaccacaaaaaacctggcggcagcgcaaaagatg

SEQ ID NO: 242251 - DNA, 103 bp, Artificial Sequence
  Synthetic Polynucleotide
taatacgactcactatagggttctggtggatgtgctggtactttttgtggaacagaggagaccacaaatggtaccagcaaacctggcggcagcgcaaaagatg

SEQ ID NO: 242252 - DNA, 103 bp, Artificial Sequence
  Synthetic Polynucleotide
taatacgactcactatagggggagaaagacttctggtggatgtgctggtaaacagaggagataccagatgatccaccagaacctggcggcagcgcaaaagatg

SEQ ID NO: 242253 - DNA, 103 bp, Artificial Sequence
  Synthetic Polynucleotide
taatacgactcactataggggctctgggcaggagaaagacttctggtggaaacagaggagatccaccatgagtctttctaacctggcggcagcgcaaaagatg

SEQ ID NO: 242254 - DNA, 103 bp, Artificial Sequence
  Synthetic Polynucleotide
taatacgactcactatagggccacaggctggctctgggcaggagaaagacaacagaggagagtctttatgctgcccagaaacctggcggcagcgcaaaagatg

SEQ ID NO: 242255 - DNA, 103 bp, Artificial Sequence
  Synthetic Polynucleotide
taatacgactcactataggggaaagacttcccacaggctggctctgggcaaacagaggagatgcccaatgccagcctgtaacctggcggcagcgcaaaagatg

SEQ ID NO: 242256 - DNA, 103 bp, Artificial Sequence
  Synthetic Polynucleotide
taatacgactcactataggggctccttgaggaggcaccactgctccatgtaacagaggagaacatggatgagtggtgccaacctggcggcagcgcaaaagatg

SEQ ID NO: 242257 - DNA, 103 bp, Artificial Sequence
  Synthetic Polynucleotide
taatacgactcactatagggtcttaaagttgaaagacttcccacaggctgaacagaggagacagcctatgggaagtcttaacctggcggcagcgcaaaagatg

SEQ ID NO: 242258 - DNA, 103 bp, Artificial Sequence
  Synthetic Polynucleotide
taatacgactcactatagggttcaggtgtttcttaaagttgaaagacttcaacagaggagagaagtcatgcaactttaaaacctggcggcagcgcaaaagatg

SEQ ID NO: 242259 - DNA, 103 bp, Artificial Sequence
  Synthetic Polynucleotide
taatacgactcactatagggcatgtgctccttcaggtgtttcttaaagttaacagaggagaaactttatgaaacacctgaacctggcggcagcgcaaaagatg

SEQ ID NO: 242260 - DNA, 103 bp, Artificial Sequence
  Synthetic Polynucleotide
taatacgactcactatagggtgtgcagcttcatgtgctccttcaggtgttaacagaggagaaacaccatgaggagcacaaacctggcggcagcgcaaaagatg

SEQ ID NO: 242261 - DNA, 103 bp, Artificial Sequence
  Synthetic Polynucleotide
taatacgactcactatagggcgggtgtcactgtgcagcttcatgtgctccaacagaggagaggagcaatggaagctgcaaacctggcggcagcgcaaaagatg

SEQ ID NO: 242262 - DNA, 103 bp, Artificial Sequence
  Synthetic Polynucleotide
taatacgactcactataggggatgtagtcccgggtgtcactgtgcagcttaacagaggagaaagctgatgagtgacaccaacctggcggcagcgcaaaagatg

SEQ ID NO: 242263 - DNA, 103 bp, Artificial Sequence
  Synthetic Polynucleotide
taatacgactcactatagggagaactcacagatgtagtcccgggtgtcacaacagaggagagtgacaatggggactacaaacctggcggcagcgcaaaagatg

SEQ ID NO: 242264 - DNA, 103 bp, Artificial Sequence
  Synthetic Polynucleotide
taatacgactcactataggggaccgggcgcagaactcacagatgtagtccaacagaggagaggactaatgctgtgagttaacctggcggcagcgcaaaagatg

SEQ ID NO: 242265 - DNA, 103 bp, Artificial Sequence
  Synthetic Polynucleotide
taatacgactcactatagggagtgcggaaagaccgggcgcagaactcacaaacagaggagatgtgagatgtgcgcccggaacctggcggcagcgcaaaagatg

SEQ ID NO: 242266 - DNA, 103 bp, Artificial Sequence
  Synthetic Polynucleotide
taatacgactcactatagggggttgctgctagtgcggaaagaccgggcgcaacagaggagagcgcccatgctttccgcaaacctggcggcagcgcaaaagatg

SEQ ID NO: 242267 - DNA, 103 bp, Artificial Sequence
  Synthetic Polynucleotide
taatacgactcactatagggaagcccagccgctccttgaggaggcaccacaacagaggagagtggtgatgcctcaaggaaacctggcggcagcgcaaaagatg

SEQ ID NO: 242268 - DNA, 103 bp, Artificial Sequence
  Synthetic Polynucleotide
taatacgactcactatagggtggatgacaaggttgctgctagtgcggaaaaacagaggagatttccgatgtagcagcaaaacctggcggcagcgcaaaagatg

SEQ ID NO: 242269 - DNA, 103 bp, Artificial Sequence
  Synthetic Polynucleotide
taatacgactcactataggggatacgtctgtggatgacaaggttgctgctaacagaggagaagcagcatgcttgtcatcaacctggcggcagcgcaaaagatg

SEQ ID NO: 242270 - DNA, 103 bp, Artificial Sequence
  Synthetic Polynucleotide
taatacgactcactatagggctccagtgtggatacgtctgtggatgacaaaacagaggagattgtcaatgacagacgtaaacctggcggcagcgcaaaagatg

SEQ ID NO: 242271 - DNA, 103 bp, Artificial Sequence
  Synthetic Polynucleotide
taatacgactcactatagggaggggtttttctccagtgtggatacgtctgaacagaggagacagacgatgccacactggaacctggcggcagcgcaaaagatg

SEQ ID NO: 242272 - DNA, 103 bp, Artificial Sequence
  Synthetic Polynucleotide
taatacgactcactatagggctcacactgcaggggtttttctccagtgtgaacagaggagacacactatggaaaaacccaacctggcggcagcgcaaaagatg

SEQ ID NO: 242273 - DNA, 103 bp, Artificial Sequence
  Synthetic Polynucleotide
taatacgactcactatagggacccgcatatctcacactgcaggggtttttaacagaggagaaaaaacatgtgcagtgtgaacctggcggcagcgcaaaagatg

SEQ ID NO: 242274 - DNA, 103 bp, Artificial Sequence
  Synthetic Polynucleotide
taatacgactcactatagggcggcaggtaaacccgcatatctcacactgcaacagaggagagcagtgatggatatgcggaacctggcggcagcgcaaaagatg

SEQ ID NO: 242275 - DNA, 103 bp, Artificial Sequence
  Synthetic Polynucleotide
taatacgactcactatagggagccttctggcggcaggtaaacccgcatataacagaggagaatatgcatgtttacctgcaacctggcggcagcgcaaaagatg

SEQ ID NO: 242276 - DNA, 103 bp, Artificial Sequence
  Synthetic Polynucleotide
taatacgactcactatagggagttcagggaagccttctggcggcaggtaaaacagaggagattacctatggccagaaggaacctggcggcagcgcaaaagatg

SEQ ID NO: 242277 - DNA, 103 bp, Artificial Sequence
  Synthetic Polynucleotide
taatacgactcactatagggcgctggtgccagttcagggaagccttctggaacagaggagaccagaaatgttccctgaaaacctggcggcagcgcaaaagatg

SEQ ID NO: 242278 - DNA, 103 bp, Artificial Sequence
  Synthetic Polynucleotide
taatacgactcactataggggtgcagggagaagcccagccgctccttgagaacagaggagactcaagatgcggctgggcaacctggcggcagcgcaaaagatg

SEQ ID NO: 242279 - DNA, 103 bp, Artificial Sequence
  Synthetic Polynucleotide
taatacgactcactatagggtgcatgcttgcgctggtgccagttcagggaaacagaggagatccctgatgtggcaccagaacctggcggcagcgcaaaagatg

SEQ ID NO: 242280 - DNA, 103 bp, Artificial Sequence
  Synthetic Polynucleotide
taatacgactcactatagggccaccgtctctgcatgcttgcgctggtgccaacagaggagaggcaccatggcaagcatgaacctggcggcagcgcaaaagatg

SEQ ID NO: 242281 - DNA, 103 bp, Artificial Sequence
  Synthetic Polynucleotide
taatacgactcactatagggcgcaaggcagccaccgtctctgcatgcttgaacagaggagacaagcaatgagagacggtaacctggcggcagcgcaaaagatg

SEQ ID NO: 242282 - DNA, 103 bp, Artificial Sequence
  Synthetic Polynucleotide
taatacgactcactatagggacaggggaagcgcaaggcagccaccgtctcaacagaggagagagacgatggctgccttgaacctggcggcagcgcaaaagatg

SEQ ID NO: 242283 - DNA, 103 bp, Artificial Sequence
  Synthetic Polynucleotide
taatacgactcactatagggcgcagaattcacaggggaagcgcaaggcagaacagaggagactgcctatggcttcccctaacctggcggcagcgcaaaagatg

SEQ ID NO: 242284 - DNA, 103 bp, Artificial Sequence
  Synthetic Polynucleotide
taatacgactcactatagggaagcgcttgccgcagaattcacaggggaagaacagaggagacttcccatgtgaattctgaacctggcggcagcgcaaaagatg

SEQ ID NO: 242285 - DNA, 103 bp, Artificial Sequence
  Synthetic Polynucleotide
taatacgactcactatagggtggcttctcaaagcgcttgccgcagaattcaacagaggagagaattcatgggcaagcgcaacctggcggcagcgcaaaagatg

SEQ ID NO: 242286 - DNA, 103 bp, Artificial Sequence
  Synthetic Polynucleotide
taatacgactcactatagggcaacactgtctggcttctcaaagcgcttgcaacagaggagagcaagcatgttgagaagcaacctggcggcagcgcaaaagatg

SEQ ID NO: 242287 - DNA, 103 bp, Artificial Sequence
  Synthetic Polynucleotide
taatacgactcactatagggcggtgggctgcaacactgtctggcttctcaaacagaggagatgagaaatgagacagtgtaacctggcggcagcgcaaaagatg

SEQ ID NO: 242288 - DNA, 103 bp, Artificial Sequence
  Synthetic Polynucleotide
taatacgactcactatagggacttttgctacggtgggctgcaacactgtcaacagaggagagacagtatggcagcccacaacctggcggcagcgcaaaagatg

SEQ ID NO: 242289 - DNA, 103 bp, Artificial Sequence
  Synthetic Polynucleotide
taatacgactcactatagggcgagctgcgagtgcagggagaagcccagccaacagaggagaggctggatgtctccctgcaacctggcggcagcgcaaaagatg

SEQ ID NO: 242290 - DNA, 103 bp, Artificial Sequence
  Synthetic Polynucleotide
taatacgactcactataggggggctgggtgacttttgctacggtgggctgaacagaggagacagcccatggtagcaaaaaacctggcggcagcgcaaaagatg

SEQ ID NO: 242291 - DNA, 103 bp, Artificial Sequence
  Synthetic Polynucleotide
taatacgactcactataggggctagaagcagggctgggtgacttttgctaaacagaggagatagcaaatgtcacccagcaacctggcggcagcgcaaaagatg

SEQ ID NO: 242292 - DNA, 103 bp, Artificial Sequence
  Synthetic Polynucleotide
taatacgactcactatagggctcttgaggggctagaagcagggctgggtgaacagaggagacacccaatgctgcttctaaacctggcggcagcgcaaaagatg

SEQ ID NO: 242293 - DNA, 103 bp, Artificial Sequence
  Synthetic Polynucleotide
taatacgactcactatagggcactgggtgactcttgaggggctagaagcaaacagaggagatgcttcatgcccctcaagaacctggcggcagcgcaaaagatg

SEQ ID NO: 242294 - DNA, 103 bp, Artificial Sequence
  Synthetic Polynucleotide
taatacgactcactatagggtctaggggaccactgggtgactcttgagggaacagaggagaccctcaatggtcacccagaacctggcggcagcgcaaaagatg

SEQ ID NO: 242295 - DNA, 103 bp, Artificial Sequence
  Synthetic Polynucleotide
taatacgactcactataggggggacagggctctaggggaccactgggtgaaacagaggagatcacccatgggtcccctaaacctggcggcagcgcaaaagatg

SEQ ID NO: 242296 - DNA, 103 bp, Artificial Sequence
  Synthetic Polynucleotide
taatacgactcactatagggcagagatgctgggacagggctctaggggacaacagaggagagtccccatgagccctgtcaacctggcggcagcgcaaaagatg

SEQ ID NO: 242297 - DNA, 103 bp, Artificial Sequence
  Synthetic Polynucleotide
taatacgactcactatagggggcccaggggcagagatgctgggacagggcaacagaggagagccctgatgcagcatctcaacctggcggcagcgcaaaagatg

SEQ ID NO: 242298 - DNA, 103 bp, Artificial Sequence
  Synthetic Polynucleotide
taatacgactcactatagggggatcccagaggcccaggggcagagatgctaacagaggagaagcatcatggcccctgggaacctggcggcagcgcaaaagatg

SEQ ID NO: 242299 - DNA, 103 bp, Artificial Sequence
  Synthetic Polynucleotide
taatacgactcactatagggacccctcgctggatcccagaggcccaggggaacagaggagacccctgatgctctgggataacctggcggcagcgcaaaagatg

SEQ ID NO: 242300 - DNA, 103 bp, Artificial Sequence
  Synthetic Polynucleotide
taatacgactcactatagggaggaacttggcgagctgcgagtgcagggagaacagaggagactccctatgctcgcagctaacctggcggcagcgcaaaagatg

SEQ ID NO: 242301 - DNA, 103 bp, Artificial Sequence
  Synthetic Polynucleotide
taatacgactcactataggggagggcctggacccctcgctggatcccagaaacagaggagatctgggatgcagcgagggaacctggcggcagcgcaaaagatg

SEQ ID NO: 242302 - DNA, 103 bp, Artificial Sequence
  Synthetic Polynucleotide
taatacgactcactatagggaggagatgcagagggcctggacccctcgctaacagaggagaagcgagatgtccaggcccaacctggcggcagcgcaaaagatg

SEQ ID NO: 242303 - DNA, 103 bp, Artificial Sequence
  Synthetic Polynucleotide
taatacgactcactatagggttggagcctgaggagatgcagagggcctggaacagaggagaccaggcatgctgcatctcaacctggcggcagcgcaaaagatg

SEQ ID NO: 242304 - DNA, 103 bp, Artificial Sequence
  Synthetic Polynucleotide
taatacgactcactatagggggaagcagggttggagcctgaggagatgcaaacagaggagatgcatcatgtcaggctccaacctggcggcagcgcaaaagatg

SEQ ID NO: 242305 - DNA, 103 bp, Artificial Sequence
  Synthetic Polynucleotide
taatacgactcactatagggtcattgctgaggaagcagggttggagcctgaacagaggagacaggctatgaccctgcttaacctggcggcagcgcaaaagatg

SEQ ID NO: 242306 - DNA, 103 bp, Artificial Sequence
  Synthetic Polynucleotide
taatacgactcactatagggccggtccaacaggaacttggcgagctgcgaaacagaggagatcgcagatggccaagttcaacctggcggcagcgcaaaagatg

SEQ ID NO: 242307 - DNA, 103 bp, Artificial Sequence
  Synthetic Polynucleotide
taatacgactcactatagggaagaagtgtaccggtccaacaggaacttggaacagaggagaccaagtatgtgttggaccaacctggcggcagcgcaaaagatg

SEQ ID NO: 242308 - DNA, 103 bp, Artificial Sequence
  Synthetic Polynucleotide
taatacgactcactatagggacacagcctgaagaagtgtaccggtccaacaacagaggagagttggaatggtacacttcaacctggcggcagcgcaaaagatg

SEQ ID NO: 242309 - DNA, 103 bp, Artificial Sequence
  Synthetic Polynucleotide
taatacgactcactatagggtgcacagaggacacagcctgaagaagtgtaaacagaggagatacactatgtcaggctgtaacctggcggcagcgcaaaagatg

SEQ ID NO: 242310 - DNA, 103 bp, Artificial Sequence
  Synthetic Polynucleotide
taatacgactcactataggggccgcctgcaggacacgtccaccgccggggaacagaggagaccccggatgtggacgtgtaacctggcggcagcgcaaaagatg

SEQ ID NO: 242311 - DNA, 103 bp, Artificial Sequence
  Synthetic Polynucleotide
taatacgactcactataggggctcaggacctgcacagaggacacagcctgaacagaggagacaggctatgtcctctgtgaacctggcggcagcgcaaaagatg

SEQ ID NO: 242312 - DNA, 103 bp, Artificial Sequence
  Synthetic Polynucleotide
taatacgactcactatagggggaggcaaaggctcaggacctgcacagaggaacagaggagacctctgatgaggtcctgaaacctggcggcagcgcaaaagatg

SEQ ID NO: 242313 - DNA, 103 bp, Artificial Sequence
  Synthetic Polynucleotide
taatacgactcactatagggcagaccttttggaggcaaaggctcaggaccaacagaggagaggtcctatgcctttgcctaacctggcggcagcgcaaaagatg

SEQ ID NO: 242314 - DNA, 103 bp, Artificial Sequence
  Synthetic Polynucleotide
taatacgactcactatagggccagatactgcagaccttttggaggcaaagaacagaggagactttgcatgcaaaaggtcaacctggcggcagcgcaaaagatg

SEQ ID NO: 242315 - DNA, 103 bp, Artificial Sequence
  Synthetic Polynucleotide
taatacgactcactataggggacaagagcaccagatactgcagaccttttaacagaggagaaaaaggatggcagtatctaacctggcggcagcgcaaaagatg

SEQ ID NO: 242316 - DNA, 103 bp, Artificial Sequence
  Synthetic Polynucleotide
taatacgactcactataggggtgggcatgagacaagagcaccagatactgaacagaggagacagtatatggtgctcttgaacctggcggcagcgcaaaagatg

SEQ ID NO: 242317 - DNA, 103 bp, Artificial Sequence
  Synthetic Polynucleotide
taatacgactcactatagggactctcggctgtgggcatgagacaagagcaaacagaggagatgctctatgctcatgcccaacctggcggcagcgcaaaagatg

SEQ ID NO: 242318 - DNA, 103 bp, Artificial Sequence
  Synthetic Polynucleotide
taatacgactcactatagggaccaggctgcactctcggctgtgggcatgaaacagaggagatcatgcatgcagccgagaaacctggcggcagcgcaaaagatg

SEQ ID NO: 242319 - DNA, 103 bp, Artificial Sequence
  Synthetic Polynucleotide
taatacgactcactatagggaagcccgggcaccaggctgcactctcggctaacagaggagaagccgaatgtgcagcctgaacctggcggcagcgcaaaagatg

SEQ ID NO: 242320 - DNA, 103 bp, Artificial Sequence
  Synthetic Polynucleotide
taatacgactcactatagggcaggcccccgaagcccgggcaccaggctgcaacagaggagagcagccatgtgcccgggcaacctggcggcagcgcaaaagatg

SEQ ID NO: 242321 - DNA, 103 bp, Artificial Sequence
  Synthetic Polynucleotide
taatacgactcactatagggcgcttctcccgccgcctgcaggacacgtccaacagaggagaggacgtatgctgcaggcgaacctggcggcagcgcaaaagatg

SEQ ID NO: 242322 - DNA, 103 bp, Artificial Sequence
  Synthetic Polynucleotide
taatacgactcactatagggtcttggccgccaggcccccgaagcccgggcaacagaggagagcccggatgtcgggggccaacctggcggcagcgcaaaagatg

SEQ ID NO: 242323 - DNA, 103 bp, Artificial Sequence
  Synthetic Polynucleotide
taatacgactcactatagggaagccccccatcttggccgccaggcccccgaacagaggagacgggggatgggcggccaaaacctggcggcagcgcaaaagatg

SEQ ID NO: 242324 - DNA, 103 bp, Artificial Sequence
  Synthetic Polynucleotide
taatacgactcactatagggactcccacacaagccccccatcttggccgcaacagaggagagcggccatgatggggggcaacctggcggcagcgcaaaagatg

SEQ ID NO: 242325 - DNA, 103 bp, Artificial Sequence
  Synthetic Polynucleotide
taatacgactcactatagggcctgctgagcactcccacacaagccccccaaacagaggagatgggggatgtgtgtgggaaacctggcggcagcgcaaaagatg

SEQ ID NO: 242326 - DNA, 103 bp, Artificial Sequence
  Synthetic Polynucleotide
taatacgactcactataggggaaggtatggcctgctgagcactcccacacaacagaggagagtgtggatgtgctcagcaaacctggcggcagcgcaaaagatg

SEQ ID NO: 242327 - DNA, 103 bp, Artificial Sequence
  Synthetic Polynucleotide
taatacgactcactataggggtccccaggagaaggtatggcctgctgagcaacagaggagagctcagatggccatacctaacctggcggcagcgcaaaagatg

SEQ ID NO: 242328 - DNA, 103 bp, Artificial Sequence
  Synthetic Polynucleotide
taatacgactcactatagggctcaaagagggtccccaggagaaggtatggaacagaggagaccatacatgctcctggggaacctggcggcagcgcaaaagatg

SEQ ID NO: 242329 - DNA, 103 bp, Artificial Sequence
  Synthetic Polynucleotide
taatacgactcactatagggaggtgtagggctcaaagagggtccccaggaaacagaggagatcctggatgccctctttgaacctggcggcagcgcaaaagatg

SEQ ID NO: 242330 - DNA, 103 bp, Artificial Sequence
  Synthetic Polynucleotide
taatacgactcactataggggtgcctctgaaggtgtagggctcaaagaggaacagaggagacctcttatggccctacacaacctggcggcagcgcaaaagatg

SEQ ID NO: 242331 - DNA, 103 bp, Artificial Sequence
  Synthetic Polynucleotide
taatacgactcactataggggctggcttgggtgcctctgaaggtgtagggaacagaggagaccctacatgttcagaggcaacctggcggcagcgcaaaagatg

SEQ ID NO: 242332 - DNA, 103 bp, Artificial Sequence
  Synthetic Polynucleotide
taatacgactcactatagggcagctgccgccgcttctcccgccgcctgcaaacagaggagatgcaggatgcgggagaagaacctggcggcagcgcaaaagatg

SEQ ID NO: 242333 - DNA, 103 bp, Artificial Sequence
  Synthetic Polynucleotide
taatacgactcactatagggtggaagggaggctggcttgggtgcctctgaaacagaggagatcagagatgcccaagccaaacctggcggcagcgcaaaagatg

SEQ ID NO: 242334 - DNA, 103 bp, Artificial Sequence
  Synthetic Polynucleotide
taatacgactcactataggggagtagtatgtggaagggaggctggcttggaacagaggagaccaagcatgcctcccttcaacctggcggcagcgcaaaagatg

SEQ ID NO: 242335 - DNA, 103 bp, Artificial Sequence
  Synthetic Polynucleotide
taatacgactcactatagggcaacttctccgagtagtatgtggaagggagaacagaggagactccctatgacatactacaacctggcggcagcgcaaaagatg

SEQ ID NO: 242336 - DNA, 103 bp, Artificial Sequence
  Synthetic Polynucleotide
taatacgactcactatagggctcggaacaccaacttctccgagtagtatgaacagaggagacatactatgcggagaagtaacctggcggcagcgcaaaagatg

SEQ ID NO: 242337 - DNA, 103 bp, Artificial Sequence
  Synthetic Polynucleotide
taatacgactcactatagggcactcgtggcctcggaacaccaacttctccaacagaggagaggagaaatgggtgttccgaacctggcggcagcgcaaaagatg

SEQ ID NO: 242338 - DNA, 103 bp, Artificial Sequence
  Synthetic Polynucleotide
taatacgactcactatagggagctcctgcccactcgtggcctcggaacacaacagaggagagtgttcatgggccacgagaacctggcggcagcgcaaaagatg

SEQ ID NO: 242339 - DNA, 103 bp, Artificial Sequence
  Synthetic Polynucleotide
taatacgactcactatagggcaaatctgcaagctcctgcccactcgtggcaacagaggagagccacgatggggcaggagaacctggcggcagcgcaaaagatg

SEQ ID NO: 242340 - DNA, 103 bp, Artificial Sequence
  Synthetic Polynucleotide
taatacgactcactataggggctcagattccaaatctgcaagctcctgccaacagaggagaggcaggatgttgcagattaacctggcggcagcgcaaaagatg

SEQ ID NO: 242341 - DNA, 103 bp, Artificial Sequence
  Synthetic Polynucleotide
taatacgactcactatagggctctcatcatgctcagattccaaatctgcaaacagaggagatgcagaatgggaatctgaaacctggcggcagcgcaaaagatg

SEQ ID NO: 242342 - DNA, 103 bp, Artificial Sequence
  Synthetic Polynucleotide
taatacgactcactatagggctcttgagtcctctcatcatgctcagattcaacagaggagagaatctatgcatgatgagaacctggcggcagcgcaaaagatg

SEQ ID NO: 242343 - DNA, 103 bp, Artificial Sequence
  Synthetic Polynucleotide
taatacgactcactatagggggcgcgcgtccagctgccgccgcttctcccaacagaggagagggagaatgggcggcagcaacctggcggcagcgcaaaagatg

SEQ ID NO: 242344 - DNA, 103 bp, Artificial Sequence
  Synthetic Polynucleotide
taatacgactcactataggggcaacctggcctcttgagtcctctcatcataacagaggagaatgatgatgggactcaagaacctggcggcagcgcaaaagatg

SEQ ID NO: 242345 - DNA, 103 bp, Artificial Sequence
  Synthetic Polynucleotide
taatacgactcactatagggaccctcctgggcaacctggcctcttgagtcaacagaggagagactcaatgggccaggttaacctggcggcagcgcaaaagatg

SEQ ID NO: 242346 - DNA, 103 bp, Artificial Sequence
  Synthetic Polynucleotide
taatacgactcactatagggtgggggtcccaccctcctgggcaacctggcaacagaggagagccaggatgcccaggaggaacctggcggcagcgcaaaagatg

SEQ ID NO: 242347 - DNA, 103 bp, Artificial Sequence
  Synthetic Polynucleotide
taatacgactcactatagggaggtctctggtgggggtcccaccctcctggaacagaggagaccaggaatgtgggaccccaacctggcggcagcgcaaaagatg

SEQ ID NO: 242348 - DNA, 103 bp, Artificial Sequence
  Synthetic Polynucleotide
taatacgactcactatagggggaggtgggaaggtctctggtgggggtcccaacagaggagagggaccatgaccagagacaacctggcggcagcgcaaaagatg

SEQ ID NO: 242349 - DNA, 103 bp, Artificial Sequence
  Synthetic Polynucleotide
taatacgactcactatagggttcctctcctggaggtgggaaggtctctggaacagaggagaccagagatgttcccacctaacctggcggcagcgcaaaagatg

SEQ ID NO: 242350 - DNA, 103 bp, Artificial Sequence
  Synthetic Polynucleotide
taatacgactcactatagggcctcaccctcttcctctcctggaggtgggaaacagaggagatcccacatgcaggagaggaacctggcggcagcgcaaaagatg

SEQ ID NO: 242351 - DNA, 103 bp, Artificial Sequence
  Synthetic Polynucleotide
taatacgactcactatagggtcctcttcttcctcaccctcttcctctcctaacagaggagaaggagaatgagagggtgaaacctggcggcagcgcaaaagatg

SEQ ID NO: 242352 - DNA, 103 bp, Artificial Sequence
  Synthetic Polynucleotide
taatacgactcactatagggctcatcattgtcctcttcttcctcaccctcaacagaggagagagggtatggaagaagagaacctggcggcagcgcaaaagatg

SEQ ID NO: 242353 - DNA, 103 bp, Artificial Sequence
  Synthetic Polynucleotide
taatacgactcactatagggcctcttcatcctcatcattgtcctcttcttaacagaggagaaagaagatgacaatgatgaacctggcggcagcgcaaaagatg

SEQ ID NO: 242354 - DNA, 103 bp, Artificial Sequence
  Synthetic Polynucleotide
taatacgactcactatagggcacttgctgcggcgcgcgtccagctgccgcaacagaggagagcggcaatgggacgcgcgaacctggcggcagcgcaaaagatg

SEQ ID NO: 242355 - DNA, 103 bp, Artificial Sequence
  Synthetic Polynucleotide
taatacgactcactatagggctgagcatctcctcttcatcctcatcattgaacagaggagacaatgaatgggatgaagaaacctggcggcagcgcaaaagatg

SEQ ID NO: 242356 - DNA, 103 bp, Artificial Sequence
  Synthetic Polynucleotide
taatacgactcactataggggctggcatcactgagcatctcctcttcatcaacagaggagagatgaaatggagatgctcaacctggcggcagcgcaaaagatg

SEQ ID NO: 242357 - DNA, 103 bp, Artificial Sequence
  Synthetic Polynucleotide
taatacgactcactatagggaggtccataagctggcatcactgagcatctaacagaggagaagatgcatggtgatgccaaacctggcggcagcgcaaaagatg

SEQ ID NO: 242358 - DNA, 103 bp, Artificial Sequence
  Synthetic Polynucleotide
taatacgactcactataggggaggagctgtaggtccataagctggcatcaaacagaggagatgatgcatgcttatggacaacctggcggcagcgcaaaagatg

SEQ ID NO: 242359 - DNA, 103 bp, Artificial Sequence
  Synthetic Polynucleotide
taatacgactcactatagggatcatctggggaggagctgtaggtccataaaacagaggagattatggatgtacagctccaacctggcggcagcgcaaaagatg

SEQ ID NO: 242360 - DNA, 103 bp, Artificial Sequence
  Synthetic Polynucleotide
taatacgactcactatagggcaggctcactatcatctggggaggagctgtaacagaggagaacagctatgccccagatgaacctggcggcagcgcaaaagatg

SEQ ID NO: 242361 - DNA, 103 bp, Artificial Sequence
  Synthetic Polynucleotide
taatacgactcactatagggctgggggcatcaggctcactatcatctgggaacagaggagacccagaatgtagtgagccaacctggcggcagcgcaaaagatg

SEQ ID NO: 242362 - DNA, 103 bp, Artificial Sequence
  Synthetic Polynucleotide
taatacgactcactatagggaggcagtagtctgggggcatcaggctcactaacagaggagaagtgagatggatgcccccaacctggcggcagcgcaaaagatg

SEQ ID NO: 242363 - DNA, 103 bp, Artificial Sequence
  Synthetic Polynucleotide
taatacgactcactatagggtgacaggggaaggcagtagtctgggggcataacagaggagaatgcccatggactactgcaacctggcggcagcgcaaaagatg

SEQ ID NO: 242364 - DNA, 103 bp, Artificial Sequence
  Synthetic Polynucleotide
taatacgactcactatagggggtgtgcaggtgacaggggaaggcagtagtaacagaggagaactactatgttcccctgtaacctggcggcagcgcaaaagatg

SEQ ID NO: 242365 - DNA, 103 bp, Artificial Sequence
  Synthetic Polynucleotide
taatacgactcactataggggcggatgcggcacttgctgcggcgcgcgtcaacagaggagagacgcgatgcgcagcaagaacctggcggcagcgcaaaagatg

SEQ ID NO: 242366 - DNA, 103 bp, Artificial Sequence
  Synthetic Polynucleotide
taatacgactcactatagggcccctctttaggtgtgcaggtgacaggggaaacagaggagatcccctatgacctgcacaaacctggcggcagcgcaaaagatg

SEQ ID NO: 242367 - DNA, 103 bp, Artificial Sequence
  Synthetic Polynucleotide
taatacgactcactataggggtggtgtctccccctctttaggtgtgcaggaacagaggagacctgcaatgctaaagaggaacctggcggcagcgcaaaagatg

SEQ ID NO: 242368 - DNA, 103 bp, Artificial Sequence
  Synthetic Polynucleotide
taatacgactcactataggggcaggggctggtggtgtctccccctctttaaacagaggagataaagaatgggagacaccaacctggcggcagcgcaaaagatg

SEQ ID NO: 242369 - DNA, 103 bp, Artificial Sequence
  Synthetic Polynucleotide
taatacgactcactatagggggagagtgctgcaggggctggtggtgtctcaacagaggagagagacaatgccagcccctaacctggcggcagcgcaaaagatg

SEQ ID NO: 242370 - DNA, 103 bp, Artificial Sequence
  Synthetic Polynucleotide
taatacgactcactatagggcaagaggactggagagtgctgcaggggctgaacagaggagacagcccatgcagcactctaacctggcggcagcgcaaaagatg

SEQ ID NO: 242371 - DNA, 103 bp, Artificial Sequence
  Synthetic Polynucleotide
taatacgactcactataggggccggcacagcaagaggactggagagtgctaacagaggagaagcactatgcagtcctctaacctggcggcagcgcaaaagatg

SEQ ID NO: 242372 - DNA, 103 bp, Artificial Sequence
  Synthetic Polynucleotide
taatacgactcactatagggtgctgacaaggccggcacagcaagaggactaacagaggagaagtcctatggctgtgccgaacctggcggcagcgcaaaagatg

SEQ ID NO: 242373 - DNA, 103 bp, Artificial Sequence
  Synthetic Polynucleotide
taatacgactcactatagggtcaatgaggatgctgacaaggccggcacagaacagaggagactgtgcatgccttgtcagaacctggcggcagcgcaaaagatg

SEQ ID NO: 242374 - DNA, 103 bp, Artificial Sequence
  Synthetic Polynucleotide
taatacgactcactataggggctctggaactcaatgaggatgctgacaagaacagaggagacttgtcatgatcctcattaacctggcggcagcgcaaaagatg

SEQ ID NO: 242375 - DNA, 103 bp, Artificial Sequence
  Synthetic Polynucleotide
taatacgactcactatagggaggtggaggagctctggaactcaatgaggaaacagaggagatcctcaatgagttccagaaacctggcggcagcgcaaaagatg

SEQ ID NO: 242376 - DNA, 103 bp, Artificial Sequence
  Synthetic Polynucleotide
taatacgactcactatagggggccgcccaggcggatgcggcacttgctgcaacagaggagagcagcaatggccgcatccaacctggcggcagcgcaaaagatg

SEQ ID NO: 242377 - DNA, 103 bp, Artificial Sequence
  Synthetic Polynucleotide
taatacgactcactatagggtgacttctgcaggtggaggagctctggaacaacagaggagagttccaatgctcctccacaacctggcggcagcgcaaaagatg

SEQ ID NO: 242378 - DNA, 103 bp, Artificial Sequence
  Synthetic Polynucleotide
taatacgactcactatagggggctgcaccctgacttctgcaggtggaggaaacagaggagatcctccatgtgcagaagtaacctggcggcagcgcaaaagatg

SEQ ID NO: 242379 - DNA, 103 bp, Artificial Sequence
  Synthetic Polynucleotide
taatacgactcactataggggctgagctgtggctgcaccctgacttctgcaacagaggagagcagaaatgagggtgcagaacctggcggcagcgcaaaagatg

SEQ ID NO: 242380 - DNA, 103 bp, Artificial Sequence
  Synthetic Polynucleotide
taatacgactcactataggggaggggtcctgctgagctgtggctgcacccaacagaggagagggtgcatgcacagctcaaacctggcggcagcgcaaaagatg

SEQ ID NO: 242381 - DNA, 103 bp, Artificial Sequence
  Synthetic Polynucleotide
taatacgactcactatagggtgggccgcttgaggggtcctgctgagctgtaacagaggagaacagctatgcaggaccccaacctggcggcagcgcaaaagatg

SEQ ID NO: 242382 - DNA, 103 bp, Artificial Sequence
  Synthetic Polynucleotide
taatacgactcactatagggctcagtctgctgggccgcttgaggggtcctaacagaggagaaggaccatgcaagcggccaacctggcggcagcgcaaaagatg

SEQ ID NO: 242383 - DNA, 103 bp, Artificial Sequence
  Synthetic Polynucleotide
taatacgactcactatagggtggccagggcctcagtctgctgggccgcttaacagaggagaaagcggatgagcagactgaacctggcggcagcgcaaaagatg

SEQ ID NO: 242384 - DNA, 103 bp, Artificial Sequence
  Synthetic Polynucleotide
taatacgactcactatagggctcccagtgctggccagggcctcagtctgcaacagaggagagcagacatgggccctggcaacctggcggcagcgcaaaagatg

SEQ ID NO: 242385 - DNA, 103 bp, Artificial Sequence
  Synthetic Polynucleotide
taatacgactcactatagggctgggcctgactcccagtgctggccagggcaacagaggagagccctgatgagcactgggaacctggcggcagcgcaaaagatg

SEQ ID NO: 242386 - DNA, 103 bp, Artificial Sequence
  Synthetic Polynucleotide
taatacgactcactatagggttggagcagactgggcctgactcccagtgcaacagaggagagcactgatggtcaggcccaacctggcggcagcgcaaaagatg

SEQ ID NO: 242387 - DNA, 103 bp, Artificial Sequence
  Synthetic Polynucleotide
taatacgactcactatagggtgctccatgtggccgcccaggcggatgcggaacagaggagaccgcatatgcctgggcggaacctggcggcagcgcaaaagatg

SEQ ID NO: 242388 - DNA, 103 bp, Artificial Sequence
  Synthetic Polynucleotide
taatacgactcactatagggcaggccggggttggagcagactgggcctgaaacagaggagatcaggcatggtctgctccaacctggcggcagcgcaaaagatg

SEQ ID NO: 242389 - DNA, 103 bp, Artificial Sequence
  Synthetic Polynucleotide
taatacgactcactataggggtcctcatcccaggccggggttggagcagaaacagaggagatctgctatgaccccggccaacctggcggcagcgcaaaagatg

SEQ ID NO: 242390 - DNA, 103 bp, Artificial Sequence
  Synthetic Polynucleotide
taatacgactcactatagggtttgtgcagtgtcctcatcccaggccggggaacagaggagaccccggatggggatgaggaacctggcggcagcgcaaaagatg

SEQ ID NO: 242391 - DNA, 103 bp, Artificial Sequence
  Synthetic Polynucleotide
taatacgactcactatagggttggggccaatttgtgcagtgtcctcatccaacagaggagaggatgaatgcactgcacaaacctggcggcagcgcaaaagatg

SEQ ID NO: 242392 - DNA, 103 bp, Artificial Sequence
  Synthetic Polynucleotide
taatacgactcactatagggcctaattctcttggggccaatttgtgcagtaacagaggagaactgcaatgattggccccaacctggcggcagcgcaaaagatg

SEQ ID NO: 242393 - DNA, 103 bp, Artificial Sequence
  Synthetic Polynucleotide
taatacgactcactatagggtggcagctttcctaattctcttggggccaaaacagaggagattggccatgagagaattaaacctggcggcagcgcaaaagatg

SEQ ID NO: 242394 - DNA, 103 bp, Artificial Sequence
  Synthetic Polynucleotide
taatacgactcactatagggagctctcttttggcagctttcctaattctcaacagaggagagagaatatggaaagctgcaacctggcggcagcgcaaaagatg

SEQ ID NO: 242395 - DNA, 103 bp, Artificial Sequence
  Synthetic Polynucleotide
taatacgactcactatagggacaaggcatcagctctcttttggcagctttaacagaggagaaaagctatgaaaagagagaacctggcggcagcgcaaaagatg

SEQ ID NO: 242396 - DNA, 103 bp, Artificial Sequence
  Synthetic Polynucleotide
taatacgactcactatagggcagggaagtcacaaggcatcagctctctttaacagaggagaaaagagatgtgatgccttaacctggcggcagcgcaaaagatg

SEQ ID NO: 242397 - DNA, 103 bp, Artificial Sequence
  Synthetic Polynucleotide
taatacgactcactatagggcttccacagccagggaagtcacaaggcatcaacagaggagagatgccatgtgacttcccaacctggcggcagcgcaaaagatg

SEQ ID NO: 242398 - DNA, 103 bp, Artificial Sequence
  Synthetic Polynucleotide
taatacgactcactatagggtaagtcctctgactgaaatgtgaaggtcataacagaggagaatgaccatgacatttcagaacctggcggcagcgcaaaagatg

SEQ ID NO: 242399 - DNA, 103 bp, Artificial Sequence
  Synthetic Polynucleotide
taatacgactcactatagggggcttttttggtgtctgctgttttcacatcaacagaggagagatgtgatgacagcagacaacctggcggcagcgcaaaagatg

SEQ ID NO: 242400 - DNA, 103 bp, Artificial Sequence
  Synthetic Polynucleotide
taatacgactcactataggggaaagtgaccggaggagattgccaggaaataacagaggagaatttccatgcaatctcctaacctggcggcagcgcaaaagatg

SEQ ID NO: 242401 - DNA, 103 bp, Artificial Sequence
  Synthetic Polynucleotide
taatacgactcactatagggggatgcctgtgaaagtgaccggaggagattaacagaggagaaatctcatgcggtcacttaacctggcggcagcgcaaaagatg

SEQ ID NO: 242402 - DNA, 103 bp, Artificial Sequence
  Synthetic Polynucleotide
taatacgactcactatagggggtgacactgggatgcctgtgaaagtgaccaacagaggagaggtcacatgcacaggcataacctggcggcagcgcaaaagatg

SEQ ID NO: 242403 - DNA, 103 bp, Artificial Sequence
  Synthetic Polynucleotide
taatacgactcactatagggatgatgtgtgggtgacactgggatgcctgtaacagaggagaacaggcatgccagtgtcaaacctggcggcagcgcaaaagatg

SEQ ID NO: 242404 - DNA, 103 bp, Artificial Sequence
  Synthetic Polynucleotide
taatacgactcactatagggtgcccaccggatgatgtgtgggtgacactgaacagaggagacagtgtatgccacacatcaacctggcggcagcgcaaaagatg

SEQ ID NO: 242405 - DNA, 103 bp, Artificial Sequence
  Synthetic Polynucleotide
taatacgactcactatagggtgctctcctgtgcccaccggatgatgtgtgaacagaggagacacacaatgtccggtgggaacctggcggcagcgcaaaagatg

SEQ ID NO: 242406 - DNA, 103 bp, Artificial Sequence
  Synthetic Polynucleotide
taatacgactcactatagggatgctgtctctgctctcctgtgcccaccggaacagaggagaccggtgatgacaggagagaacctggcggcagcgcaaaagatg

SEQ ID NO: 242407 - DNA, 103 bp, Artificial Sequence
  Synthetic Polynucleotide
taatacgactcactatagggccgtgtgcgcatgctgtctctgctctcctgaacagaggagacaggagatgagagacagcaacctggcggcagcgcaaaagatg

SEQ ID NO: 242408 - DNA, 103 bp, Artificial Sequence
  Synthetic Polynucleotide
taatacgactcactataggggaggacaggaccgtgtgcgcatgctgtctcaacagaggagagagacaatgtgcgcacacaacctggcggcagcgcaaaagatg

SEQ ID NO: 242409 - DNA, 103 bp, Artificial Sequence
  Synthetic Polynucleotide
taatacgactcactatagggtctgggtggggaggacaggaccgtgtgcgcaacagaggagagcgcacatggtcctgtccaacctggcggcagcgcaaaagatg

SEQ ID NO: 242410 - DNA, 103 bp, Artificial Sequence
  Synthetic Polynucleotide
taatacgactcactatagggggatccggctggcttttttggtgtctgctgaacagaggagacagcagatgccaaaaaagaacctggcggcagcgcaaaagatg

SEQ ID NO: 242411 - DNA, 103 bp, Artificial Sequence
  Synthetic Polynucleotide
taatacgactcactatagggtgactgtgcctctgggtggggaggacaggaaacagaggagatcctgtatgccccacccaaacctggcggcagcgcaaaagatg

SEQ ID NO: 242412 - DNA, 103 bp, Artificial Sequence
  Synthetic Polynucleotide
taatacgactcactatagggttccttaagctgactgtgcctctgggtgggaacagaggagacccaccatgaggcacagtaacctggcggcagcgcaaaagatg

SEQ ID NO: 242413 - DNA, 103 bp, Artificial Sequence
  Synthetic Polynucleotide
taatacgactcactatagggtcccctgggcttccttaagctgactgtgccaacagaggagaggcacaatgagcttaaggaacctggcggcagcgcaaaagatg

SEQ ID NO: 242414 - DNA, 103 bp, Artificial Sequence
  Synthetic Polynucleotide
taatacgactcactatagggttttgccctctcccctgggcttccttaagcaacagaggagagcttaaatgagcccagggaacctggcggcagcgcaaaagatg

SEQ ID NO: 242415 - DNA, 103 bp, Artificial Sequence
  Synthetic Polynucleotide
taatacgactcactatagggttccgacactttttgccctctcccctgggcaacagaggagagcccagatgagagggcaaaacctggcggcagcgcaaaagatg

SEQ ID NO: 242416 - DNA, 103 bp, Artificial Sequence
  Synthetic Polynucleotide
taatacgactcactatagggcccgtacaccttccgacactttttgccctcaacagaggagagagggcatgaagtgtcggaacctggcggcagcgcaaaagatg

SEQ ID NO: 242417 - DNA, 103 bp, Artificial Sequence
  Synthetic Polynucleotide
taatacgactcactatagggggttctccatcccgtacaccttccgacactaacagaggagaagtgtcatgaggtgtacgaacctggcggcagcgcaaaagatg

SEQ ID NO: 242418 - DNA, 103 bp, Artificial Sequence
  Synthetic Polynucleotide
taatacgactcactatagggcacatgtctcggttctccatcccgtacaccaacagaggagaggtgtaatggatggagaaaacctggcggcagcgcaaaagatg

SEQ ID NO: 242419 - DNA, 103 bp, Artificial Sequence
  Synthetic Polynucleotide
taatacgactcactatagggggcggtacaccacatgtctcggttctccataacagaggagaatggagatgcgagacatgaacctggcggcagcgcaaaagatg

SEQ ID NO: 242420 - DNA, 103 bp, Artificial Sequence
  Synthetic Polynucleotide
taatacgactcactatagggtccagcggcaggcggtacaccacatgtctcaacagaggagagagacaatgggtgtaccgaacctggcggcagcgcaaaagatg

SEQ ID NO: 242421 - DNA, 103 bp, Artificial Sequence
  Synthetic Polynucleotide
taatacgactcactatagggtcatggtcaaggatccggctggcttttttgaacagaggagacaaaaaatgcagccggataacctggcggcagcgcaaaagatg

SEQ ID NO: 242422 - DNA, 103 bp, Artificial Sequence
  Synthetic Polynucleotide
taatacgactcactatagggcaggccttcttccagcggcaggcggtacacaacagaggagagtgtacatgctgccgctgaacctggcggcagcgcaaaagatg

SEQ ID NO: 242423 - DNA, 103 bp, Artificial Sequence
  Synthetic Polynucleotide
taatacgactcactataggggaacctctggcaggccttcttccagcggcaaacagaggagatgccgcatgaagaaggccaacctggcggcagcgcaaaagatg

SEQ ID NO: 242424 - DNA, 103 bp, Artificial Sequence
  Synthetic Polynucleotide
taatacgactcactataggggttttctttttcatggtcaaggatccggctaacagaggagaagccggatgcttgaccataacctggcggcagcgcaaaagatg

SEQ ID NO: 242425 - DNA, 103 bp, Artificial Sequence
  Synthetic Polynucleotide
taatacgactcactatagggtggagcgagtgttttctttttcatggtcaaaacagaggagattgaccatgaaaaagaaaaacctggcggcagcgcaaaagatg

SEQ ID NO: 242426 - DNA, 103 bp, Artificial Sequence
  Synthetic Polynucleotide
taatacgactcactatagggaggagacagatggagcgagtgttttcttttaacagaggagaaaaagaatgcactcgctcaacctggcggcagcgcaaaagatg

SEQ ID NO: 242427 - DNA, 103 bp, Artificial Sequence
  Synthetic Polynucleotide
taatacgactcactatagggtttttgctcaaggagacagatggagcgagtaacagaggagaactcgcatgatctgtctcaacctggcggcagcgcaaaagatg

SEQ ID NO: 242428 - DNA, 103 bp, Artificial Sequence
  Synthetic Polynucleotide
taatacgactcactatagggcaacttttcttttttgctcaaggagacagaaacagaggagatctgtcatgttgagcaaaaacctggcggcagcgcaaaagatg

SEQ ID NO: 242429 - DNA, 103 bp, Artificial Sequence
  Synthetic Polynucleotide
taatacgactcactatagggttggaggaaacaacttttcttttttgctcaaacagaggagatgagcaatgaagaaaagtaacctggcggcagcgcaaaagatg

SEQ ID NO: 242430 - DNA, 103 bp, Artificial Sequence
  Synthetic Polynucleotide
taatacgactcactatagggaacatcaatgttggaggaaacaacttttctaacagaggagaagaaaaatggtttcctccaacctggcggcagcgcaaaagatg

SEQ ID NO: 242431 - DNA, 103 bp, Artificial Sequence
  Synthetic Polynucleotide
taatacgactcactatagggagtcacgttttaagtcctctgactgaaatgaacagaggagacatttcatgcagaggactaacctggcggcagcgcaaaagatg

SEQ ID NO: 242432 - DNA, 103 bp, Artificial Sequence
  Synthetic Polynucleotide
taatacgactcactatagggttgctggaggaacatcaatgttggaggaaaaacagaggagatttcctatgacattgatgaacctggcggcagcgcaaaagatg

SEQ ID NO: 242433 - DNA, 103 bp, Artificial Sequence
  Synthetic Polynucleotide
taatacgactcactataggggaagatttccttgctggaggaacatcaatgaacagaggagacattgaatgtcctccagcaacctggcggcagcgcaaaagatg

SEQ ID NO: 242434 - DNA, 103 bp, Artificial Sequence
  Synthetic Polynucleotide
taatacgactcactatagggtagttcctctgaagatttccttgctggaggaacagaggagacctccaatgaggaaatctaacctggcggcagcgcaaaagatg

SEQ ID NO: 242435 - DNA, 103 bp, Artificial Sequence
  Synthetic Polynucleotide
taatacgactcactatagggtgtccatgtctagttcctctgaagatttccaacagaggagaggaaatatgcagaggaacaacctggcggcagcgcaaaagatg

SEQ ID NO: 242436 - DNA, 103 bp, Artificial Sequence
  Synthetic Polynucleotide
taatacgactcactataggggctgtcaccttgtccatgtctagttcctctaacagaggagaagaggaatgagacatggaaacctggcggcagcgcaaaagatg

SEQ ID NO: 242437 - DNA, 103 bp, Artificial Sequence
  Synthetic Polynucleotide
taatacgactcactatagggtaccattgctgctgtcaccttgtccatgtcaacagaggagagacatgatgaaggtgacaaacctggcggcagcgcaaaagatg

SEQ ID NO: 242438 - DNA, 103 bp, Artificial Sequence
  Synthetic Polynucleotide
taatacgactcactatagggagctggttagtaccattgctgctgtcacctaacagaggagaaggtgaatgcagcaatggaacctggcggcagcgcaaaagatg

SEQ ID NO: 242439 - DNA, 103 bp, Artificial Sequence
  Synthetic Polynucleotide
taatacgactcactatagggctagtcgacaagctggttagtaccattgctaacagaggagaagcaatatgactaaccagaacctggcggcagcgcaaaagatg

SEQ ID NO: 242440 - DNA, 103 bp, Artificial Sequence
  Synthetic Polynucleotide
taatacgactcactatagggaaccaaagggctagtcgacaagctggttagaacagaggagactaaccatgttgtcgactaacctggcggcagcgcaaaagatg

SEQ ID NO: 242441 - DNA, 103 bp, Artificial Sequence
  Synthetic Polynucleotide
taatacgactcactataggggaggacttcgaaccaaagggctagtcgacaaacagaggagatgtcgaatggccctttggaacctggcggcagcgcaaaagatg

SEQ ID NO: 242442 - DNA, 103 bp, Artificial Sequence
  Synthetic Polynucleotide
taatacgactcactatagggtttttaccacagtcacgttttaagtcctctaacagaggagaagaggaatgaaaacgtgaaacctggcggcagcgcaaaagatg

SEQ ID NO: 242443 - DNA, 103 bp, Artificial Sequence
  Synthetic Polynucleotide
taatacgactcactatagggggccgcacgggaggacttcgaaccaaagggaacagaggagaccctttatgtcgaagtccaacctggcggcagcgcaaaagatg

SEQ ID NO: 242444 - DNA, 103 bp, Artificial Sequence
  Synthetic Polynucleotide
taatacgactcactataggggctctcgttcggccgcacgggaggacttcgaacagaggagacgaagtatgcccgtgcggaacctggcggcagcgcaaaagatg

SEQ ID NO: 242445 - DNA, 103 bp, Artificial Sequence
  Synthetic Polynucleotide
taatacgactcactatagggatccgctgaggctctcgttcggccgcacggaacagaggagaccgtgcatgcgaacgagaaacctggcggcagcgcaaaagatg

SEQ ID NO: 242446 - DNA, 103 bp, Artificial Sequence
  Synthetic Polynucleotide
taatacgactcactatagggtccttccaggatccgctgaggctctcgttcaacagaggagagaacgaatgcctcagcggaacctggcggcagcgcaaaagatg

SEQ ID NO: 242447 - DNA, 103 bp, Artificial Sequence
  Synthetic Polynucleotide
taatacgactcactataggggcagccgccctccttccaggatccgctgagaacagaggagactcagcatgtcctggaagaacctggcggcagcgcaaaagatg

SEQ ID NO: 242448 - DNA, 103 bp, Artificial Sequence
  Synthetic Polynucleotide
taatacgactcactatagggtggaaggcacgcagccgccctccttccaggaacagaggagacctggaatgagggcggctaacctggcggcagcgcaaaagatg

SEQ ID NO: 242449 - DNA, 103 bp, Artificial Sequence
  Synthetic Polynucleotide
taatacgactcactatagggctgctggtgctggaaggcacgcagccgcccaacagaggagagggcggatgcgtgccttcaacctggcggcagcgcaaaagatg

SEQ ID NO: 242450 - DNA, 103 bp, Artificial Sequence
  Synthetic Polynucleotide
taatacgactcactataggggtagccgctgctgctggtgctggaaggcacaacagaggagagtgcctatgagcaccagcaacctggcggcagcgcaaaagatg

SEQ ID NO: 242451 - DNA, 103 bp, Artificial Sequence
  Synthetic Polynucleotide
taatacgactcactatagggtccagctccagtagccgctgctgctggtgcaacagaggagagcaccaatggcagcggctaacctggcggcagcgcaaaagatg

SEQ ID NO: 242452 - DNA, 103 bp, Artificial Sequence
  Synthetic Polynucleotide
taatacgactcactatagggctgggggcgctccagctccagtagccgctgaacagaggagacagcggatgctggagctgaacctggcggcagcgcaaaagatg

SEQ ID NO: 242453 - DNA, 103 bp, Artificial Sequence
  Synthetic Polynucleotide
taatacgactcactatagggatgagacatttttttaccacagtcacgtttaacagaggagaaaacgtatgtgtggtaaaaacctggcggcagcgcaaaagatg

SEQ ID NO: 242454 - DNA, 103 bp, Artificial Sequence
  Synthetic Polynucleotide
taatacgactcactatagggggactggtcgctgggggcgctccagctccaaacagaggagatggagcatgagcgcccccaacctggcggcagcgcaaaagatg

SEQ ID NO: 242455 - DNA, 103 bp, Artificial Sequence
  Synthetic Polynucleotide
taatacgactcactatagggtggacgggttggactggtcgctgggggcgcaacagaggagagcgcccatggcgaccagtaacctggcggcagcgcaaaagatg

SEQ ID NO: 242456 - DNA, 103 bp, Artificial Sequence
  Synthetic Polynucleotide
taatacgactcactatagggggcgacggcgtggacgggttggactggtcgaacagaggagacgaccaatgcaacccgtcaacctggcggcagcgcaaaagatg

SEQ ID NO: 242457 - DNA, 103 bp, Artificial Sequence
  Synthetic Polynucleotide
taatacgactcactatagggcgagagcggcggcgacggcgtggacgggttaacagaggagaaacccgatgacgccgtcgaacctggcggcagcgcaaaagatg

SEQ ID NO: 242458 - DNA, 103 bp, Artificial Sequence
  Synthetic Polynucleotide
taatacgactcactatagggagctgtcagccgagagcggcggcgacggcgaacagaggagacgccgtatgcgccgctctaacctggcggcagcgcaaaagatg

SEQ ID NO: 242459 - DNA, 103 bp, Artificial Sequence
  Synthetic Polynucleotide
taatacgactcactatagggaagggcttgaagctgtcagccgagagcggcaacagaggagagccgctatgggctgacagaacctggcggcagcgcaaaagatg

SEQ ID NO: 242460 - DNA, 103 bp, Artificial Sequence
  Synthetic Polynucleotide
taatacgactcactatagggggggctgcggaagggcttgaagctgtcagcaacagaggagagctgacatgttcaagcccaacctggcggcagcgcaaaagatg

SEQ ID NO: 242461 - DNA, 103 bp, Artificial Sequence
  Synthetic Polynucleotide
taatacgactcactatagggctggctgcgcggggctgcggaagggcttgaaacagaggagatcaagcatgtccgcagccaacctggcggcagcgcaaaagatg

SEQ ID NO: 242462 - DNA, 103 bp, Artificial Sequence
  Synthetic Polynucleotide
taatacgactcactatagggatgccgtcgtctggctgcgcggggctgcggaacagaggagaccgcagatgcgcgcagccaacctggcggcagcgcaaaagatg

SEQ ID NO: 242463 - DNA, 103 bp, Artificial Sequence
  Synthetic Polynucleotide
taatacgactcactatagggcgcctcgtcgatgccgtcgtctggctgcgcaacagaggagagcgcagatggacgacggcaacctggcggcagcgcaaaagatg

SEQ ID NO: 242464 - DNA, 103 bp, Artificial Sequence
  Synthetic Polynucleotide
taatacgactcactatagggacacgtgttgatgagacatttttttaccacaacagaggagagtggtaatgaaatgtctcaacctggcggcagcgcaaaagatg

SEQ ID NO: 242465 - DNA, 103 bp, Artificial Sequence
  Synthetic Polynucleotide
taatacgactcactatagggtgctggcctccgcctcgtcgatgccgtcgtaacagaggagaacgacgatgtcgacgaggaacctggcggcagcgcaaaagatg

SEQ ID NO: 242466 - DNA, 103 bp, Artificial Sequence
  Synthetic Polynucleotide
taatacgactcactatagggaagagcaggttgctggcctccgcctcgtcgaacagaggagacgacgaatgggaggccagaacctggcggcagcgcaaaagatg

SEQ ID NO: 242467 - DNA, 103 bp, Artificial Sequence
  Synthetic Polynucleotide
taatacgactcactataggggggctcgtcgaagagcaggttgctggcctcaacagaggagagaggccatgaacctgctcaacctggcggcagcgcaaaagatg

SEQ ID NO: 242468 - DNA, 103 bp, Artificial Sequence
  Synthetic Polynucleotide
taatacgactcactatagggtcctgggaatgggctcgtcgaagagcaggtaacagaggagaacctgcatgtcgacgagcaacctggcggcagcgcaaaagatg

SEQ ID NO: 242469 - DNA, 103 bp, Artificial Sequence
  Synthetic Polynucleotide
taatacgactcactatagggttctttcttttcctgggaatgggctcgtcgaacagaggagacgacgaatgcattcccagaacctggcggcagcgcaaaagatg

SEQ ID NO: 242470 - DNA, 103 bp, Artificial Sequence
  Synthetic Polynucleotide
taatacgactcactatagggcttcatggaattctttcttttcctgggaataacagaggagaattcccatgaaaagaaagaacctggcggcagcgcaaaagatg

SEQ ID NO: 242471 - DNA, 103 bp, Artificial Sequence
  Synthetic Polynucleotide
taatacgactcactatagggtgaacatcaccttcatggaattctttctttaacagaggagaaaagaaatgattccatgaaacctggcggcagcgcaaaagatg

SEQ ID NO: 242472 - DNA, 103 bp, Artificial Sequence
  Synthetic Polynucleotide
taatacgactcactatagggcagaggcatttgaacatcaccttcatggaaaacagaggagattccatatgggtgatgttaacctggcggcagcgcaaaagatg

SEQ ID NO: 242473 - DNA, 103 bp, Artificial Sequence
  Synthetic Polynucleotide
taatacgactcactatagggacagtttttccagaggcatttgaacatcacaacagaggagagtgatgatgaaatgcctcaacctggcggcagcgcaaaagatg

SEQ ID NO: 242474 - DNA, 103 bp, Artificial Sequence
  Synthetic Polynucleotide
taatacgactcactataggggcaccttcccacagtttttccagaggcattaacagaggagaaatgccatgggaaaaactaacctggcggcagcgcaaaagatg

SEQ ID NO: 242475 - DNA, 103 bp, Artificial Sequence
  Synthetic Polynucleotide
taatacgactcactataggggccaaggaaaacacgtgttgatgagacattaacagaggagaaatgtcatgtcaacacgtaacctggcggcagcgcaaaagatg

SEQ ID NO: 242476 - DNA, 103 bp, Artificial Sequence
  Synthetic Polynucleotide
taatacgactcactataggggcagtgctcagcaccttcccacagtttttcaacagaggagagaaaaaatgtgggaaggtaacctggcggcagcgcaaaagatg

SEQ ID NO: 242477 - DNA, 103 bp, Artificial Sequence
  Synthetic Polynucleotide
taatacgactcactataggggatacctgctgcagtgctcagcaccttcccaacagaggagagggaagatgctgagcactaacctggcggcagcgcaaaagatg

SEQ ID NO: 242478 - DNA, 103 bp, Artificial Sequence
  Synthetic Polynucleotide
taatacgactcactatagggtgtgtttctggatacctgctgcagtgctcaaacagaggagatgagcaatgcagcaggtaaacctggcggcagcgcaaaagatg

SEQ ID NO: 242479 - DNA, 103 bp, Artificial Sequence
  Synthetic Polynucleotide
taatacgactcactatagggatggttcggatgtgtttctggatacctgctaacagaggagaagcaggatgccagaaacaaacctggcggcagcgcaaaagatg

SEQ ID NO: 242480 - DNA, 103 bp, Artificial Sequence
  Synthetic Polynucleotide
taatacgactcactatagggccccagatggatggttcggatgtgtttctgaacagaggagacagaaaatgatccgaaccaacctggcggcagcgcaaaagatg

SEQ ID NO: 242481 - DNA, 103 bp, Artificial Sequence
  Synthetic Polynucleotide
taatacgactcactatagggctccaacgcgccccagatggatggttcggaaacagaggagatccgaaatgtccatctggaacctggcggcagcgcaaaagatg

SEQ ID NO: 242482 - DNA, 103 bp, Artificial Sequence
  Synthetic Polynucleotide
taatacgactcactatagggtagtcagagtctccaacgcgccccagatggaacagaggagaccatctatggcgcgttggaacctggcggcagcgcaaaagatg

SEQ ID NO: 242483 - DNA, 103 bp, Artificial Sequence
  Synthetic Polynucleotide
taatacgactcactatagggtccatcactgtagtcagagtctccaacgcgaacagaggagacgcgttatggactctgacaacctggcggcagcgcaaaagatg

SEQ ID NO: 242484 - DNA, 103 bp, Artificial Sequence
  Synthetic Polynucleotide
taatacgactcactatagggagtcctcttctccatcactgtagtcagagtaacagaggagaactctgatgacagtgatgaacctggcggcagcgcaaaagatg

SEQ ID NO: 242485 - DNA, 103 bp, Artificial Sequence
  Synthetic Polynucleotide
taatacgactcactataggggtgtagtaaaagtcctcttctccatcactgaacagaggagacagtgaatgagaagaggaaacctggcggcagcgcaaaagatg

SEQ ID NO: 242486 - DNA, 103 bp, Artificial Sequence
  Synthetic Polynucleotide
taatacgactcactatagggttcctccatggccaaggaaaacacgtgttgaacagaggagacaacacatgttttccttgaacctggcggcagcgcaaaagatg

SEQ ID NO: 242487 - DNA, 103 bp, Artificial Sequence
  Synthetic Polynucleotide
taatacgactcactatagggcttgatctcagtgtagtaaaagtcctcttcaacagaggagagaagagatgttttactacaacctggcggcagcgcaaaagatg

SEQ ID NO: 242488 - DNA, 103 bp, Artificial Sequence
  Synthetic Polynucleotide
taatacgactcactatagggctgtgttgagcttgatctcagtgtagtaaaaacagaggagatttactatgctgagatcaaacctggcggcagcgcaaaagatg

SEQ ID NO: 242489 - DNA, 103 bp, Artificial Sequence
  Synthetic Polynucleotide
taatacgactcactataggggccactgagtctgtgttgagcttgatctcaaacagaggagatgagatatggctcaacacaacctggcggcagcgcaaaagatg

SEQ ID NO: 242490 - DNA, 103 bp, Artificial Sequence
  Synthetic Polynucleotide
taatacgactcactatagggcagcccgtctgccactgagtctgtgttgagaacagaggagactcaacatggactcagtgaacctggcggcagcgcaaaagatg

SEQ ID NO: 242491 - DNA, 103 bp, Artificial Sequence
  Synthetic Polynucleotide
taatacgactcactatagggccaggctgctcagcccgtctgccactgagtaacagaggagaactcagatgcagacgggcaacctggcggcagcgcaaaagatg

SEQ ID NO: 242492 - DNA, 103 bp, Artificial Sequence
  Synthetic Polynucleotide
taatacgactcactataggggagaccggggccaggctgctcagcccgtctaacagaggagaagacggatggagcagcctaacctggcggcagcgcaaaagatg

SEQ ID NO: 242493 - DNA, 103 bp, Artificial Sequence
  Synthetic Polynucleotide
taatacgactcactatagggctgggaaggtgagaccggggccaggctgctaacagaggagaagcagcatggccccggtcaacctggcggcagcgcaaaagatg

SEQ ID NO: 242494 - DNA, 103 bp, Artificial Sequence
  Synthetic Polynucleotide
taatacgactcactatagggaagccagggactgggaaggtgagaccggggaacagaggagaccccggatgcaccttcccaacctggcggcagcgcaaaagatg

SEQ ID NO: 242495 - DNA, 103 bp, Artificial Sequence
  Synthetic Polynucleotide
taatacgactcactataggggtaggaggtgaagccagggactgggaaggtaacagaggagaaccttcatggtccctggcaacctggcggcagcgcaaaagatg

SEQ ID NO: 242496 - DNA, 103 bp, Artificial Sequence
  Synthetic Polynucleotide
taatacgactcactataggggatggggaaagtaggaggtgaagccagggaaacagaggagatccctgatgtcacctcctaacctggcggcagcgcaaaagatg

SEQ ID NO: 242497 - DNA, 103 bp, Artificial Sequence
  Synthetic Polynucleotide
taatacgactcactatagggttttcacatcttcctccatggccaaggaaaaacagaggagatttcctatgccatggaggaacctggcggcagcgcaaaagatg

SEQ ID NO: 242498 - DNA, 103 bp, Artificial Sequence
  Synthetic Polynucleotide
taatacgactcactatagggttgaatctgggatggggaaagtaggaggtgaacagaggagacacctcatgctttccccaaacctggcggcagcgcaaaagatg

SEQ ID NO: 242499 - DNA, 103 bp, Artificial Sequence
  Synthetic Polynucleotide
taatacgactcactatagggtctgttcggcttgaatctgggatggggaaaaacagaggagatttcccatgcccagattcaacctggcggcagcgcaaaagatg

SEQ ID NO: 242500 - DNA, 103 bp, Artificial Sequence
  Synthetic Polynucleotide
taatacgactcactatagggacaaggagtttctgttcggcttgaatctggaacagaggagaccagatatgagccgaacaaacctggcggcagcgcaaaagatg

SEQ ID NO: 242501 - DNA, 103 bp, Artificial Sequence
  Synthetic Polynucleotide
taatacgactcactatagggccgttttggcacaaggagtttctgttcggcaacagaggagagccgaaatgaaactccttaacctggcggcagcgcaaaagatg

SEQ ID NO: 242502 - DNA, 103 bp, Artificial Sequence
  Synthetic Polynucleotide
taatacgactcactatagggaacttagtctccgttttggcacaaggagttaacagaggagaaactccatgtgccaaaacaacctggcggcagcgcaaaagatg

SEQ ID NO: 242503 - DNA, 103 bp, Artificial Sequence
  Synthetic Polynucleotide
taatacgactcactatagggcggcgtcatcaacttagtctccgttttggcaacagaggagagccaaaatggagactaagaacctggcggcagcgcaaaagatg

SEQ ID NO: 242504 - DNA, 103 bp, Artificial Sequence
  Synthetic Polynucleotide
taatacgactcactatagggagcggctcaacggcgtcatcaacttagtctaacagaggagaagactaatgtgatgacgcaacctggcggcagcgcaaaagatg

SEQ ID NO: 242505 - DNA, 103 bp, Artificial Sequence
  Synthetic Polynucleotide
taatacgactcactataggggtgggagctgagcggctcaacggcgtcatcaacagaggagagatgacatggttgagccgaacctggcggcagcgcaaaagatg

SEQ ID NO: 242506 - DNA, 103 bp, Artificial Sequence
  Synthetic Polynucleotide
taatacgactcactataggggtagagggtggtgggagctgagcggctcaaaacagaggagattgagcatgtcagctcccaacctggcggcagcgcaaaagatg

SEQ ID NO: 242507 - DNA, 103 bp, Artificial Sequence
  Synthetic Polynucleotide
taatacgactcactatagggtgtgcacgaggtagagggtggtgggagctgaacagaggagacagctcatgccaccctctaacctggcggcagcgcaaaagatg

SEQ ID NO: 242508 - DNA, 103 bp, Artificial Sequence
  Synthetic Polynucleotide
taatacgactcactataggggtgtctgctgttttcacatcttcctccatgaacagaggagacatggaatgagatgtgaaaacctggcggcagcgcaaaagatg

SEQ ID NO: 242509 - DNA, 103 bp, Artificial Sequence
  Synthetic Polynucleotide
taatacgactcactataggggcatggtcagtgtgcacgaggtagagggtgaacagaggagacaccctatgcctcgtgcaaacctggcggcagcgcaaaagatg

SEQ ID NO: 242510 - DNA, 103 bp, Artificial Sequence
  Synthetic Polynucleotide
taatacgactcactatagggggcctggtaagcatggtcagtgtgcacgagaacagaggagactcgtgatgactgaccataacctggcggcagcgcaaaagatg

SEQ ID NO: 242511 - DNA, 103 bp, Artificial Sequence
  Synthetic Polynucleotide
taatacgactcactatagggcagggggtgtggcctggtaagcatggtcagaacagaggagactgaccatgcttaccaggaacctggcggcagcgcaaaagatg

SEQ ID NO: 242512 - DNA, 103 bp, Artificial Sequence
  Synthetic Polynucleotide
taatacgactcactatagggggaatggtcacagggggtgtggcctggtaaaacagaggagattaccaatgcacacccccaacctggcggcagcgcaaaagatg

SEQ ID NO: 242513 - DNA, 103 bp, Artificial Sequence
  Synthetic Polynucleotide
taatacgactcactatagggggccgatcctggaatggtcacagggggtgtaacagaggagaacacccatggtgaccattaacctggcggcagcgcaaaagatg

SEQ ID NO: 242514 - DNA, 103 bp, Artificial Sequence
  Synthetic Polynucleotide
taatacgactcactataggggggtgaacttggccgatcctggaatggtcaaacagaggagatgaccaatgcaggatcggaacctggcggcagcgcaaaagatg

SEQ ID NO: 242515 - DNA, 103 bp, Artificial Sequence
  Synthetic Polynucleotide
taatacgactcactatagggctgccattgggggtgaacttggccgatcctaacagaggagaaggatcatgcaagttcacaacctggcggcagcgcaaaagatg

SEQ ID NO: 242516 - DNA, 103 bp, Artificial Sequence
  Synthetic Polynucleotide
taatacgactcactataggggctgaagctgctgccattgggggtgaacttaacagaggagaaagttcatgcccaatggcaacctggcggcagcgcaaaagatg

SEQ ID NO: 242517 - DNA, 103 bp, Artificial Sequence
  Synthetic Polynucleotide
taatacgactcactataggggccaggaaatgctgaagctgctgccattggaacagaggagaccaatgatggcagcttcaaacctggcggcagcgcaaaagatg

SEQ ID NO: 242518 - DNA, 103 bp, Artificial Sequence
  Synthetic Polynucleotide
taatacgactcactatagggggaggagattgccaggaaatgctgaagctgaacagaggagacagcttatgcatttcctgaacctggcggcagcgcaaaagatg

SEQ ID NO: 242519 - DNA, 103 bp, Artificial Sequence
  Synthetic Polynucleotide
taatacgactcactatagggagccacatcctcaaagaccactgagtccataacagaggagaatggacatggtggtctttaacctggcggcagcgcaaaagatg

SEQ ID NO: 242520 - DNA, 103 bp, Artificial Sequence
  Synthetic Polynucleotide
taatacgactcactatagggcaagttaacaaaggtttcttgcatcacatcaacagaggagagatgtgatgcaagaaaccaacctggcggcagcgcaaaagatg

SEQ ID NO: 242521 - DNA, 103 bp, Artificial Sequence
  Synthetic Polynucleotide
taatacgactcactatagggttccttacaatcatagggtttctctcctgtaacagaggagaacaggaatgaaaccctataacctggcggcagcgcaaaagatg

SEQ ID NO: 242522 - DNA, 103 bp, Artificial Sequence
  Synthetic Polynucleotide
taatacgactcactatagggctttcccacattccttacaatcatagggttaacagaggagaaaccctatgattgtaaggaacctggcggcagcgcaaaagatg

SEQ ID NO: 242523 - DNA, 103 bp, Artificial Sequence
  Synthetic Polynucleotide
taatacgactcactataggggaaatgaatgctttcccacattccttacaaaacagaggagattgtaaatgatgtgggaaaacctggcggcagcgcaaaagatg

SEQ ID NO: 242524 - DNA, 103 bp, Artificial Sequence
  Synthetic Polynucleotide
taatacgactcactataggggcttggaagagaaatgaatgctttcccacaaacagaggagatgtgggatggcattcattaacctggcggcagcgcaaaagatg

SEQ ID NO: 242525 - DNA, 103 bp, Artificial Sequence
  Synthetic Polynucleotide
taatacgactcactataggggtcttcgatagcttggaagagaaatgaatgaacagaggagacattcaatgctcttccaaaacctggcggcagcgcaaaagatg

SEQ ID NO: 242526 - DNA, 103 bp, Artificial Sequence
  Synthetic Polynucleotide
taatacgactcactatagggattatcatatgtcttcgatagcttggaagaaacagaggagatcttccatgctatcgaagaacctggcggcagcgcaaaagatg

SEQ ID NO: 242527 - DNA, 103 bp, Artificial Sequence
  Synthetic Polynucleotide
taatacgactcactatagggtccagtgtgcattatcatatgtcttcgataaacagaggagatatcgaatgcatatgataaacctggcggcagcgcaaaagatg

SEQ ID NO: 242528 - DNA, 103 bp, Artificial Sequence
  Synthetic Polynucleotide
taatacgactcactatagggaaggtccatttccagtgtgcattatcatataacagaggagaatatgaatgtgcacactgaacctggcggcagcgcaaaagatg

SEQ ID NO: 242529 - DNA, 103 bp, Artificial Sequence
  Synthetic Polynucleotide
taatacgactcactatagggttgcatttataaggtccatttccagtgtgcaacagaggagagcacacatgaaatggaccaacctggcggcagcgcaaaagatg

SEQ ID NO: 242530 - DNA, 103 bp, Artificial Sequence
  Synthetic Polynucleotide
taatacgactcactatagggcccacattccttgcatttataaggtccattaacagaggagaaatggaatgtataaatgcaacctggcggcagcgcaaaagatg

SEQ ID NO: 242531 - DNA, 103 bp, Artificial Sequence
  Synthetic Polynucleotide
taatacgactcactatagggctatagaggccaagttaacaaaggtttcttaacagaggagaaagaaaatgttgttaactaacctggcggcagcgcaaaagatg

SEQ ID NO: 242532 - DNA, 103 bp, Artificial Sequence
  Synthetic Polynucleotide
taatacgactcactatagggcaaaggctttcccacattccttgcatttataacagaggagaataaatatgaggaatgtgaacctggcggcagcgcaaaagatg

SEQ ID NO: 242533 - DNA, 103 bp, Artificial Sequence
  Synthetic Polynucleotide
taatacgactcactatagggctaggacaatcaaaggctttcccacattccaacagaggagaggaatgatggaaagccttaacctggcggcagcgcaaaagatg

SEQ ID NO: 242534 - DNA, 103 bp, Artificial Sequence
  Synthetic Polynucleotide
taatacgactcactatagggttgaaaagaactaggacaatcaaaggctttaacagaggagaaaagccatggattgtcctaacctggcggcagcgcaaaagatg

SEQ ID NO: 242535 - DNA, 103 bp, Artificial Sequence
  Synthetic Polynucleotide
taatacgactcactataggggttcatggatttgaaaagaactaggacaataacagaggagaattgtcatggttcttttcaacctggcggcagcgcaaaagatg

SEQ ID NO: 242536 - DNA, 103 bp, Artificial Sequence
  Synthetic Polynucleotide
taatacgactcactataggggtgtgagttcgttcatggatttgaaaagaaaacagaggagattctttatgaatccatgaaacctggcggcagcgcaaaagatg

SEQ ID NO: 242537 - DNA, 103 bp, Artificial Sequence
  Synthetic Polynucleotide
taatacgactcactatagggtttctctccagtgtgagttcgttcatggataacagaggagaatccatatgcgaactcacaacctggcggcagcgcaaaagatg

SEQ ID NO: 242538 - DNA, 103 bp, Artificial Sequence
  Synthetic Polynucleotide
taatacgactcactatagggattcatagggtttctctccagtgtgagttcaacagaggagagaactcatgctggagagaaacctggcggcagcgcaaaagatg

SEQ ID NO: 242539 - DNA, 103 bp, Artificial Sequence
  Synthetic Polynucleotide
taatacgactcactatagggcactgtttacattcatagggtttctctccaaacagaggagatggagaatgaccctatgaaacctggcggcagcgcaaaagatg

SEQ ID NO: 242540 - DNA, 103 bp, Artificial Sequence
  Synthetic Polynucleotide
taatacgactcactatagggggctttaccacactgtttacattcatagggaacagaggagaccctatatgtgtaaacagaacctggcggcagcgcaaaagatg

SEQ ID NO: 242541 - DNA, 103 bp, Artificial Sequence
  Synthetic Polynucleotide
taatacgactcactatagggaacaactgaaggctttaccacactgtttacaacagaggagagtaaacatggtggtaaagaacctggcggcagcgcaaaagatg

SEQ ID NO: 242542 - DNA, 103 bp, Artificial Sequence
  Synthetic Polynucleotide
taatacgactcactatagggcagttttcccctatagaggccaagttaacaaacagaggagatgttaaatgggcctctataacctggcggcagcgcaaaagatg

SEQ ID NO: 242543 - DNA, 103 bp, Artificial Sequence
  Synthetic Polynucleotide
taatacgactcactatagggaaggaactggaacaactgaaggctttaccaaacagaggagatggtaaatgcttcagttgaacctggcggcagcgcaaaagatg

SEQ ID NO: 242544 - DNA, 103 bp, Artificial Sequence
  Synthetic Polynucleotide
taatacgactcactatagggatgcattcgaaaggaactggaacaactgaaaacagaggagattcagtatgtccagttccaacctggcggcagcgcaaaagatg

SEQ ID NO: 242545 - DNA, 103 bp, Artificial Sequence
  Synthetic Polynucleotide
taatacgactcactataggggagttctttcatgcattcgaaaggaactggaacagaggagaccagttatgttcgaatgcaacctggcggcagcgcaaaagatg

SEQ ID NO: 242546 - DNA, 103 bp, Artificial Sequence
  Synthetic Polynucleotide
taatacgactcactatagggtctccagtgtgagttctttcatgcattcgaaacagaggagatcgaatatgtgaaagaacaacctggcggcagcgcaaaagatg

SEQ ID NO: 242547 - DNA, 103 bp, Artificial Sequence
  Synthetic Polynucleotide
taatacgactcactatagggatggggtttctctccagtgtgagttctttcaacagaggagagaaagaatgcacactggaaacctggcggcagcgcaaaagatg

SEQ ID NO: 242548 - DNA, 103 bp, Artificial Sequence
  Synthetic Polynucleotide
taatacgactcactataggggtttacattcatggggtttctctccagtgtaacagaggagaacactgatgagaaaccccaacctggcggcagcgcaaaagatg

SEQ ID NO: 242549 - DNA, 103 bp, Artificial Sequence
  Synthetic Polynucleotide
taatacgactcactatagggttaccacattgtttacattcatggggtttcaacagaggagagaaaccatgtgaatgtaaaacctggcggcagcgcaaaagatg

SEQ ID NO: 242550 - DNA, 103 bp, Artificial Sequence
  Synthetic Polynucleotide
taatacgactcactatagggactgaaggctttaccacattgtttacattcaacagaggagagaatgtatgcaatgtggtaacctggcggcagcgcaaaagatg

SEQ ID NO: 242551 - DNA, 103 bp, Artificial Sequence
  Synthetic Polynucleotide
taatacgactcactatagggaactggaacaactgaaggctttaccacattaacagaggagaaatgtgatgaagccttcaaacctggcggcagcgcaaaagatg

SEQ ID NO: 242552 - DNA, 103 bp, Artificial Sequence
  Synthetic Polynucleotide
taatacgactcactatagggattcgaacagaactggaacaactgaaggctaacagaggagaagccttatgttgttccagaacctggcggcagcgcaaaagatg

SEQ ID NO: 242553 - DNA, 103 bp, Artificial Sequence
  Synthetic Polynucleotide
taatacgactcactatagggcttctcctcccagttttcccctatagaggcaacagaggagagcctctatgggggaaaacaacctggcggcagcgcaaaagatg

SEQ ID NO: 242554 - DNA, 103 bp, Artificial Sequence
  Synthetic Polynucleotide
taatacgactcactatagggcctttcatgtattcgaacagaactggaacaaacagaggagatgttccatgtctgttcgaaacctggcggcagcgcaaaagatg

SEQ ID NO: 242555 - DNA, 103 bp, Artificial Sequence
  Synthetic Polynucleotide
taatacgactcactatagggcagtgtgagtcctttcatgtattcgaacagaacagaggagactgttcatgtacatgaaaaacctggcggcagcgcaaaagatg

SEQ ID NO: 242556 - DNA, 103 bp, Artificial Sequence
  Synthetic Polynucleotide
taatacgactcactatagggggtttctctccagtgtgagtcctttcatgtaacagaggagaacatgaatggactcacacaacctggcggcagcgcaaaagatg

SEQ ID NO: 242557 - DNA, 103 bp, Artificial Sequence
  Synthetic Polynucleotide
taatacgactcactatagggacattcatagggtttctctccagtgtgagtaacagaggagaactcacatgggagagaaaaacctggcggcagcgcaaaagatg

SEQ ID NO: 242558 - DNA, 103 bp, Artificial Sequence
  Synthetic Polynucleotide
taatacgactcactatagggcacactgtttacattcatagggtttctctcaacagaggagagagagaatgcctatgaataacctggcggcagcgcaaaagatg

SEQ ID NO: 242559 - DNA, 103 bp, Artificial Sequence
  Synthetic Polynucleotide
taatacgactcactatagggaaggctttaccacactgtttacattcatagaacagaggagactatgaatgtaaacagtgaacctggcggcagcgcaaaagatg

SEQ ID NO: 242560 - DNA, 103 bp, Artificial Sequence
  Synthetic Polynucleotide
taatacgactcactatagggggaacaactgaaggctttaccacactgtttaacagaggagaaaacagatgggtaaagccaacctggcggcagcgcaaaagatg

SEQ ID NO: 242561 - DNA, 103 bp, Artificial Sequence
  Synthetic Polynucleotide
taatacgactcactataggggaaaggaactggaacaactgaaggctttacaacagaggagagtaaagatgtcagttgttaacctggcggcagcgcaaaagatg

SEQ ID NO: 242562 - DNA, 103 bp, Artificial Sequence
  Synthetic Polynucleotide
taatacgactcactatagggtcatgcattcgaaaggaactggaacaactgaacagaggagacagttgatgcagttccttaacctggcggcagcgcaaaagatg

SEQ ID NO: 242563 - DNA, 103 bp, Artificial Sequence
  Synthetic Polynucleotide
taatacgactcactataggggtgaattctttcatgcattcgaaaggaactaacagaggagaagttccatgcgaatgcataacctggcggcagcgcaaaagatg

SEQ ID NO: 242564 - DNA, 103 bp, Artificial Sequence
  Synthetic Polynucleotide
taatacgactcactatagggcttcaatgttcttctcctcccagttttcccaacagaggagagggaaaatggggaggagaaacctggcggcagcgcaaaagatg

SEQ ID NO: 242565 - DNA, 103 bp, Artificial Sequence
  Synthetic Polynucleotide
taatacgactcactatagggtctctccagtgtgaattctttcatgcattcaacagaggagagaatgcatgaaagaattcaacctggcggcagcgcaaaagatg

SEQ ID NO: 242566 - DNA, 103 bp, Artificial Sequence
  Synthetic Polynucleotide
taatacgactcactatagggtcatagggtttctctccagtgtgaattcttaacagaggagaaagaatatgcactggagaaacctggcggcagcgcaaaagatg

SEQ ID NO: 242567 - DNA, 103 bp, Artificial Sequence
  Synthetic Polynucleotide
taatacgactcactatagggctgtttacattcatagggtttctctccagtaacagaggagaactggaatgaaaccctataacctggcggcagcgcaaaagatg

SEQ ID NO: 242568 - DNA, 103 bp, Artificial Sequence
  Synthetic Polynucleotide
taatacgactcactatagggctttaccacactgtttacattcatagggttaacagaggagaaaccctatgaatgtaaacaacctggcggcagcgcaaaagatg

SEQ ID NO: 242569 - DNA, 103 bp, Artificial Sequence
  Synthetic Polynucleotide
taatacgactcactatagggaaactaaaggctttaccacactgtttacataacagaggagaatgtaaatggtgtggtaaaacctggcggcagcgcaaaagatg

SEQ ID NO: 242570 - DNA, 103 bp, Artificial Sequence
  Synthetic Polynucleotide
taatacgactcactatagggggaactagaaaaactaaaggctttaccacaaacagaggagatgtggtatggcctttagtaacctggcggcagcgcaaaagatg

SEQ ID NO: 242571 - DNA, 103 bp, Artificial Sequence
  Synthetic Polynucleotide
taatacgactcactataggggcatccgaaaggaactagaaaaactaaaggaacagaggagacctttaatgtttctagttaacctggcggcagcgcaaaagatg

SEQ ID NO: 242572 - DNA, 103 bp, Artificial Sequence
  Synthetic Polynucleotide
taatacgactcactataggggtcctttcatgcatccgaaaggaactagaaaacagaggagattctagatgctttcggataacctggcggcagcgcaaaagatg

SEQ ID NO: 242573 - DNA, 103 bp, Artificial Sequence
  Synthetic Polynucleotide
taatacgactcactatagggtccagtgtgagtcctttcatgcatccgaaaaacagaggagatttcggatgcatgaaaggaacctggcggcagcgcaaaagatg

SEQ ID NO: 242574 - DNA, 103 bp, Artificial Sequence
  Synthetic Polynucleotide
taatacgactcactatagggagggtttctctccagtgtgagtcctttcataacagaggagaatgaaaatgctcacactgaacctggcggcagcgcaaaagatg

SEQ ID NO: 242575 - DNA, 103 bp, Artificial Sequence
  Synthetic Polynucleotide
taatacgactcactatagggtttttgtgatcttcaatgttcttctcctccaacagaggagaggaggaatggaacattgaaacctggcggcagcgcaaaagatg

SEQ ID NO: 242576 - DNA, 103 bp, Artificial Sequence; identical to SEQ ID NO: 240997
  Synthetic Polynucleotide

SEQ ID NO: 242577 - DNA, 103 bp, Artificial Sequence
  Synthetic Polynucleotide
taatacgactcactatagggaccacattgtttacattcatagggtttctcaacagaggagagagaaaatgtatgaatgtaacctggcggcagcgcaaaagatg

SEQ ID NO: 242578 - DNA, 103 bp, Artificial Sequence
  Synthetic Polynucleotide
taatacgactcactatagggtgaaggctttaccacattgtttacattcataacagaggagaatgaatatgaacaatgtgaacctggcggcagcgcaaaagatg

SEQ ID NO: 242579 - DNA, 103 bp, Artificial Sequence
  Synthetic Polynucleotide
taatacgactcactatagggctggaacaactgaaggctttaccacattgtaacagaggagaacaatgatgtaaagccttaacctggcggcagcgcaaaagatg

SEQ ID NO: 242580 - DNA, 103 bp, Artificial Sequence
  Synthetic Polynucleotide
taatacgactcactatagggtcgaaaggaactggaacaactgaaggctttaacagaggagaaaagccatgagttgttccaacctggcggcagcgcaaaagatg

SEQ ID NO: 242581 - DNA, 103 bp, Artificial Sequence
  Synthetic Polynucleotide
taatacgactcactatagggtttcatgcattcgaaaggaactggaacaacaacagaggagagttgttatggttcctttcaacctggcggcagcgcaaaagatg

SEQ ID NO: 242582 - DNA, 103 bp, Artificial Sequence
  Synthetic Polynucleotide
taatacgactcactataggggtgtgagtcctttcatgcattcgaaaggaaaacagaggagattccttatgaatgcatgaaacctggcggcagcgcaaaagatg

SEQ ID NO: 242583 - DNA, 103 bp, Artificial Sequence
  Synthetic Polynucleotide
taatacgactcactatagggtttctccccagtgtgagtcctttcatgcataacagaggagaatgcatatgaggactcacaacctggcggcagcgcaaaagatg

SEQ ID NO: 242584 - DNA, 103 bp, Artificial Sequence
  Synthetic Polynucleotide
taatacgactcactatagggattcatagggtttctccccagtgtgagtccaacagaggagaggactcatgctggggagaaacctggcggcagcgcaaaagatg

SEQ ID NO: 242585 - DNA, 103 bp, Artificial Sequence
  Synthetic Polynucleotide
taatacgactcactatagggcactgtttacattcatagggtttctccccaaacagaggagatggggaatgaccctatgaaacctggcggcagcgcaaaagatg

SEQ ID NO: 242586 - DNA, 103 bp, Artificial Sequence
  Synthetic Polynucleotide
taatacgactcactatagggtctcccctgatttttgtgatcttcaatgttaacagaggagaaacattatggatcacaaaaacctggcggcagcgcaaaagatg

SEQ ID NO: 242587 - DNA, 103 bp, Artificial Sequence
  Synthetic Polynucleotide
taatacgactcactatagggcgccttaccacactgtttacattcatagggaacagaggagaccctatatgtgtaaacagaacctggcggcagcgcaaaagatg

SEQ ID NO: 242588 - DNA, 103 bp, Artificial Sequence
  Synthetic Polynucleotide
taatacgactcactatagggaacaactaaacgccttaccacactgtttacaacagaggagagtaaacatggtggtaaggaacctggcggcagcgcaaaagatg

SEQ ID NO: 242589 - DNA, 103 bp, Artificial Sequence
  Synthetic Polynucleotide
taatacgactcactatagggatggaactggaacaactaaacgccttaccaaacagaggagatggtaaatggtttagttgaacctggcggcagcgcaaaagatg

SEQ ID NO: 242590 - DNA, 103 bp, Artificial Sequence
  Synthetic Polynucleotide
taatacgactcactatagggatgtattcgaatggaactggaacaactaaaaacagaggagatttagtatgtccagttccaacctggcggcagcgcaaaagatg

SEQ ID NO: 242591 - DNA, 103 bp, Artificial Sequence
  Synthetic Polynucleotide
taatacgactcactataggggagtcctttcatgtattcgaatggaactggaacagaggagaccagttatgttcgaatacaacctggcggcagcgcaaaagatg

SEQ ID NO: 242592 - DNA, 103 bp, Artificial Sequence
  Synthetic Polynucleotide
taatacgactcactatagggtctccagtgtgagtcctttcatgtattcgaaacagaggagatcgaatatgtgaaaggacaacctggcggcagcgcaaaagatg

SEQ ID NO: 242593 - DNA, 103 bp, Artificial Sequence
  Synthetic Polynucleotide
taatacgactcactatagggataaggtttctctccagtgtgagtcctttcaacagaggagagaaaggatgcacactggaaacctggcggcagcgcaaaagatg

SEQ ID NO: 242594 - DNA, 103 bp, Artificial Sequence
  Synthetic Polynucleotide
taatacgactcactataggggtttacactcataaggtttctctccagtgtaacagaggagaacactgatgagaaaccttaacctggcggcagcgcaaaagatg

SEQ ID NO: 242595 - DNA, 103 bp, Artificial Sequence
  Synthetic Polynucleotide
taatacgactcactatagggttaccacattgtttacactcataaggtttcaacagaggagagaaaccatgtgagtgtaaaacctggcggcagcgcaaaagatg

SEQ ID NO: 242596 - DNA, 103 bp, Artificial Sequence
  Synthetic Polynucleotide
taatacgactcactatagggactgaaggccttaccacattgtttacactcaacagaggagagagtgtatgcaatgtggtaacctggcggcagcgcaaaagatg

SEQ ID NO: 242597 - DNA, 103 bp, Artificial Sequence
  Synthetic Polynucleotide
taatacgactcactatagggttcttagctttctcccctgatttttgtgataacagaggagaatcacaatgatcaggggaaacctggcggcagcgcaaaagatg

SEQ ID NO: 242598 - DNA, 103 bp, Artificial Sequence
  Synthetic Polynucleotide
taatacgactcactatagggaactagaacaactgaaggccttaccacattaacagaggagaaatgtgatgaggccttcaaacctggcggcagcgcaaaagatg

SEQ ID NO: 242599 - DNA, 103 bp, Artificial Sequence
  Synthetic Polynucleotide
taatacgactcactatagggattcgaacagaactagaacaactgaaggccaacagaggagaggccttatgttgttctagaacctggcggcagcgcaaaagatg

SEQ ID NO: 242600 - DNA, 103 bp, Artificial Sequence
  Synthetic Polynucleotide
taatacgactcactatagggcctttcatgcattcgaacagaactagaacaaacagaggagatgttctatgtctgttcgaaacctggcggcagcgcaaaagatg

SEQ ID NO: 242601 - DNA, 103 bp, Artificial Sequence
  Synthetic Polynucleotide
taatacgactcactatagggcagtgtgagtcctttcatgcattcgaacagaacagaggagactgttcatgtgcatgaaaaacctggcggcagcgcaaaagatg

SEQ ID NO: 242602 - DNA, 103 bp, Artificial Sequence
  Synthetic Polynucleotide
taatacgactcactatagggggtttcactccagtgtgagtcctttcatgcaacagaggagagcatgaatggactcacacaacctggcggcagcgcaaaagatg

SEQ ID NO: 242603 - DNA, 103 bp, Artificial Sequence
  Synthetic Polynucleotide
taatacgactcactatagggacattcatagggtttcactccagtgtgagtaacagaggagaactcacatgggagtgaaaaacctggcggcagcgcaaaagatg

SEQ ID NO: 242604 - DNA, 103 bp, Artificial Sequence
  Synthetic Polynucleotide
taatacgactcactatagggcacattgtttacattcatagggtttcactcaacagaggagagagtgaatgcctatgaataacctggcggcagcgcaaaagatg

SEQ ID NO: 242605 - DNA, 103 bp, Artificial Sequence
  Synthetic Polynucleotide
taatacgactcactatagggaaggctttgtcacattgtttacattcatagaacagaggagactatgaatgtaaacaatgaacctggcggcagcgcaaaagatg

SEQ ID NO: 242606 - DNA, 103 bp, Artificial Sequence
  Synthetic Polynucleotide
taatacgactcactatagggtgagcaactgaaggctttgtcacattgtttaacagaggagaaaacaaatggacaaagccaacctggcggcagcgcaaaagatg

SEQ ID NO: 242607 - DNA, 103 bp, Artificial Sequence
  Synthetic Polynucleotide
taatacgactcactataggggaaaggaacgtgagcaactgaaggctttgtaacagaggagaacaaagatgtcagttgctaacctggcggcagcgcaaaagatg

SEQ ID NO: 242608 - DNA, 103 bp, Artificial Sequence
  Synthetic Polynucleotide
taatacgactcactatagggaccatatgacttcttagctttctcccctgaaacagaggagatcagggatgaaagctaagaacctggcggcagcgcaaaagatg

SEQ ID NO: 242609 - DNA, 103 bp, Artificial Sequence
  Synthetic Polynucleotide
taatacgactcactatagggtcatggattcgaaaggaacgtgagcaactgaacagaggagacagttgatgacgttccttaacctggcggcagcgcaaaagatg

SEQ ID NO: 242610 - DNA, 103 bp, Artificial Sequence
  Synthetic Polynucleotide
taatacgactcactataggggtgagttcgttcatggattcgaaaggaacgaacagaggagacgttccatgcgaatccataacctggcggcagcgcaaaagatg

SEQ ID NO: 242611 - DNA, 103 bp, Artificial Sequence
  Synthetic Polynucleotide
taatacgactcactatagggtctctccagtgtgagttcgttcatggattcaacagaggagagaatccatgaacgaactcaacctggcggcagcgcaaaagatg

SEQ ID NO: 242612 - DNA, 103 bp, Artificial Sequence
  Synthetic Polynucleotide
taatacgactcactataggggcatagggtttctctccagtgtgagttcgtaacagaggagaacgaacatgcactggagaaacctggcggcagcgcaaaagatg

SEQ ID NO: 242613 - DNA, 103 bp, Artificial Sequence
  Synthetic Polynucleotide
taatacgactcactatagggttgttgacatgcatagggtttctctccagtaacagaggagaactggaatgaaaccctataacctggcggcagcgcaaaagatg

SEQ ID NO: 242614 - DNA, 103 bp, Artificial Sequence
  Synthetic Polynucleotide
taatacgactcactatagggctttaccacattgttgacatgcatagggttaacagaggagaaaccctatgcatgtcaacaacctggcggcagcgcaaaagatg

SEQ ID NO: 242615 - DNA, 103 bp, Artificial Sequence
  Synthetic Polynucleotide
taatacgactcactatagggcacttgaaggctttaccacattgttgacataacagaggagaatgtcaatgatgtggtaaaacctggcggcagcgcaaaagatg

SEQ ID NO: 242616 - DNA, 103 bp, Artificial Sequence
  Synthetic Polynucleotide
taatacgactcactatagggggaacgggaacacttgaaggctttaccacaaacagaggagatgtggtatggccttcaagaacctggcggcagcgcaaaagatg

SEQ ID NO: 242617 - DNA, 103 bp, Artificial Sequence
  Synthetic Polynucleotide
taatacgactcactataggggtattcgaaaggaacgggaacacttgaaggaacagaggagaccttcaatggttcccgttaacctggcggcagcgcaaaagatg

SEQ ID NO: 242618 - DNA, 103 bp, Artificial Sequence
  Synthetic Polynucleotide
taatacgactcactatagggactctttcatgtattcgaaaggaacgggaaaacagaggagattcccgatgctttcgaataacctggcggcagcgcaaaagatg

SEQ ID NO: 242619 - DNA, 103 bp, Artificial Sequence
  Synthetic Polynucleotide
taatacgactcactataggggagcctctctaccatatgacttcttagcttaacagaggagaaagctaatgagtcatatgaacctggcggcagcgcaaaagatg

SEQ ID NO: 242620 - DNA, 103 bp, Artificial Sequence
  Synthetic Polynucleotide
taatacgactcactatagggtccactatgaactctttcatgtattcgaaaaacagaggagatttcgaatgcatgaaagaaacctggcggcagcgcaaaagatg

SEQ ID NO: 242621 - DNA, 103 bp, Artificial Sequence
  Synthetic Polynucleotide
taatacgactcactatagggtgaagttcacagccacatcctcaaagaccaaacagaggagatggtctatgaggatgtggaacctggcggcagcgcaaaagatg

SEQ ID NO: 242622 - DNA, 103 bp, Artificial Sequence
  Synthetic Polynucleotide
taatacgactcactatagggtcctttcacagagcctctctaccatatgacaacagaggagagtcataatgtagagaggcaacctggcggcagcgcaaaagatg

SEQ ID NO: 242623 - DNA, 103 bp, Artificial Sequence
  Synthetic Polynucleotide
taatacgactcactatagggctaccttctttcctttcacagagcctctctaacagaggagaagagagatgctgtgaaagaacctggcggcagcgcaaaagatg

SEQ ID NO: 242624 - DNA, 103 bp, Artificial Sequence
  Synthetic Polynucleotide
taatacgactcactatagggtccaaactgactaccttctttcctttcacaaacagaggagatgtgaaatgaaagaaggtaacctggcggcagcgcaaaagatg

SEQ ID NO: 242625 - DNA, 103 bp, Artificial Sequence
  Synthetic Polynucleotide
taatacgactcactatagggtgatggtttctccaaactgactaccttcttaacagaggagaaagaagatggtcagtttgaacctggcggcagcgcaaaagatg

SEQ ID NO: 242626 - DNA, 103 bp, Artificial Sequence
  Synthetic Polynucleotide
taatacgactcactatagggggagtctgactgatggtttctccaaactgaaacagaggagatcagttatgagaaaccataacctggcggcagcgcaaaagatg

SEQ ID NO: 242627 - DNA, 103 bp, Artificial Sequence
  Synthetic Polynucleotide
taatacgactcactatagggtttaggatttggagtctgactgatggtttcaacagaggagagaaaccatgagtcagactaacctggcggcagcgcaaaagatg

SEQ ID NO: 242628 - DNA, 103 bp, Artificial Sequence
  Synthetic Polynucleotide
taatacgactcactatagggtcttgtttggtttaggatttggagtctgacaacagaggagagtcagaatgcaaatcctaaacctggcggcagcgcaaaagatg

SEQ ID NO: 242629 - DNA, 103 bp, Artificial Sequence
  Synthetic Polynucleotide
taatacgactcactataggggtaaaagttttcttgtttggtttaggatttaacagaggagaaaatccatgaccaaacaaaacctggcggcagcgcaaaagatg

SEQ ID NO: 242630 - DNA, 103 bp, Artificial Sequence
  Synthetic Polynucleotide
taatacgactcactatagggttttactctagtaaaagttttcttgtttggaacagaggagaccaaacatgaaaacttttaacctggcggcagcgcaaaagatg

SEQ ID NO: 242631 - DNA, 103 bp, Artificial Sequence
  Synthetic Polynucleotide
taatacgactcactatagggattcatatggttttactctagtaaaagtttaacagaggagaaaacttatgctagagtaaaacctggcggcagcgcaaaagatg

SEQ ID NO: 242632 - DNA, 103 bp, Artificial Sequence
  Synthetic Polynucleotide
taatacgactcactatagggtcctcctgggtgaagttcacagccacatccaacagaggagaggatgtatgtgtgaacttaacctggcggcagcgcaaaagatg

SEQ ID NO: 242633 - DNA, 103 bp, Artificial Sequence
  Synthetic Polynucleotide
taatacgactcactatagggcacacactacattcatatggttttactctaaacagaggagatagagtatgaccatatgaaacctggcggcagcgcaaaagatg

SEQ ID NO: 242634 - DNA, 103 bp, Artificial Sequence
  Synthetic Polynucleotide
taatacgactcactataggggtcctttccacacacactacattcatatggaacagaggagaccatatatgtgtagtgtgaacctggcggcagcgcaaaagatg

SEQ ID NO: 242635 - DNA, 103 bp, Artificial Sequence
  Synthetic Polynucleotide
taatacgactcactataggggacacatatagtcctttccacacacactacaacagaggagagtagtgatggtggaaaggaacctggcggcagcgcaaaagatg

SEQ ID NO: 242636 - DNA, 103 bp, Artificial Sequence
  Synthetic Polynucleotide
taatacgactcactatagggagagatgaatgacacatatagtcctttccaaacagaggagatggaaaatgctatatgtgaacctggcggcagcgcaaaagatg

SEQ ID NO: 242637 - DNA, 103 bp, Artificial Sequence
  Synthetic Polynucleotide
taatacgactcactataggggtgcctattaagagatgaatgacacatataaacagaggagatatatgatgcattcatctaacctggcggcagcgcaaaagatg

SEQ ID NO: 242638 - DNA, 103 bp, Artificial Sequence
  Synthetic Polynucleotide
taatacgactcactataggggagatctcatgtgcctattaagagatgaataacagaggagaattcatatgttaataggcaacctggcggcagcgcaaaagatg

SEQ ID NO: 242639 - DNA, 103 bp, Artificial Sequence
  Synthetic Polynucleotide
taatacgactcactatagggtgttcagtatgagatctcatgtgcctattaaacagaggagataatagatgcatgagatcaacctggcggcagcgcaaaagatg

SEQ ID NO: 242640 - DNA, 103 bp, Artificial Sequence
  Synthetic Polynucleotide
taatacgactcactatagggatatgatctatgttcagtatgagatctcataacagaggagaatgagaatgcatactgaaaacctggcggcagcgcaaaagatg

SEQ ID NO: 242641 - DNA, 103 bp, Artificial Sequence
  Synthetic Polynucleotide
taatacgactcactatagggtgtgatattcatatgatctatgttcagtataacagaggagaatactgatgatagatcataacctggcggcagcgcaaaagatg

SEQ ID NO: 242642 - DNA, 103 bp, Artificial Sequence
  Synthetic Polynucleotide
taatacgactcactatagggtctccatatttgtgatattcatatgatctaaacagaggagatagatcatgtgaatatcaaacctggcggcagcgcaaaagatg

SEQ ID NO: 242643 - DNA, 103 bp, Artificial Sequence
  Synthetic Polynucleotide
taatacgactcactatagggcaaagcccactcctcctgggtgaagttcacaacagaggagagtgaacatgacccaggagaacctggcggcagcgcaaaagatg

SEQ ID NO: 242644 - DNA, 103 bp, Artificial Sequence
  Synthetic Polynucleotide
taatacgactcactatagggatatgatttctctccatatttgtgatattcaacagaggagagaatatatgaaatatggaaacctggcggcagcgcaaaagatg

SEQ ID NO: 242645 - DNA, 103 bp, Artificial Sequence
  Synthetic Polynucleotide
taatacgactcactatagggccttacattcatatgatttctctccatattaacagaggagaaatatgatgagaaatcataacctggcggcagcgcaaaagatg

SEQ ID NO: 242646 - DNA, 103 bp, Artificial Sequence
  Synthetic Polynucleotide
taatacgactcactatagggttcccacattccttacattcatatgatttcaacagaggagagaaatcatgtgaatgtaaaacctggcggcagcgcaaaagatg

SEQ ID NO: 242647 - DNA, 103 bp, Artificial Sequence
  Synthetic Polynucleotide
taatacgactcactataggggctgaatcttttcccacattccttacattcaacagaggagagaatgtatggaatgtgggaacctggcggcagcgcaaaagatg

SEQ ID NO: 242648 - DNA, 103 bp, Artificial Sequence
  Synthetic Polynucleotide
taatacgactcactatagggaacttcgaaagctgaatcttttcccacattaacagaggagaaatgtgatgaaagattcaaacctggcggcagcgcaaaagatg

SEQ ID NO: 242649 - DNA, 103 bp, Artificial Sequence
  Synthetic Polynucleotide
taatacgactcactatagggattcgaaatgaacttcgaaagctgaatcttaacagaggagaaagattatgctttcgaagaacctggcggcagcgcaaaagatg

SEQ ID NO: 242650 - DNA, 103 bp, Artificial Sequence
  Synthetic Polynucleotide
taatacgactcactatagggtctttcatgtattcgaaatgaacttcgaaaaacagaggagatttcgaatgtcatttcgaaacctggcggcagcgcaaaagatg

SEQ ID NO: 242651 - DNA, 103 bp, Artificial Sequence
  Synthetic Polynucleotide
taatacgactcactatagggcagtgtgagttctttcatgtattcgaaatgaacagaggagacatttcatgtacatgaaaaacctggcggcagcgcaaaagatg

SEQ ID NO: 242652 - DNA, 103 bp, Artificial Sequence
  Synthetic Polynucleotide
taatacgactcactatagggggtttctctccagtgtgagttctttcatgtaacagaggagaacatgaatgaactcacacaacctggcggcagcgcaaaagatg

SEQ ID NO: 242653 - DNA, 103 bp, Artificial Sequence
  Synthetic Polynucleotide
taatacgactcactatagggacatttatagggtttctctccagtgtgagtaacagaggagaactcacatgggagagaaaaacctggcggcagcgcaaaagatg

SEQ ID NO: 242654 - DNA, 103 bp, Artificial Sequence
  Synthetic Polynucleotide
taatacgactcactatagggagggacccagcaaagcccactcctcctgggaacagaggagacccaggatgagtgggcttaacctggcggcagcgcaaaagatg

SEQ ID NO: 242655 - DNA, 103 bp, Artificial Sequence
  Synthetic Polynucleotide
taatacgactcactatagggcacactgtttacatttatagggtttctctcaacagaggagagagagaatgcctataaataacctggcggcagcgcaaaagatg

SEQ ID NO: 242656 - DNA, 103 bp, Artificial Sequence
  Synthetic Polynucleotide
taatacgactcactatagggaaagccttaccacactgtttacatttatagaacagaggagactataaatgtaaacagtgaacctggcggcagcgcaaaagatg

SEQ ID NO: 242657 - DNA, 103 bp, Artificial Sequence
  Synthetic Polynucleotide
taatacgactcactataggggggccaactgaaagccttaccacactgtttaacagaggagaaaacagatgggtaaggctaacctggcggcagcgcaaaagatg

SEQ ID NO: 242658 - DNA, 103 bp, Artificial Sequence
  Synthetic Polynucleotide
taatacgactcactataggggaaaggaactgggccaactgaaagccttacaacagaggagagtaaggatgtcagttggcaacctggcggcagcgcaaaagatg

SEQ ID NO: 242659 - DNA, 103 bp, Artificial Sequence
  Synthetic Polynucleotide
taatacgactcactatagggtcatgtatttgaaaggaactgggccaactgaacagaggagacagttgatgcagttccttaacctggcggcagcgcaaaagatg

SEQ ID NO: 242660 - DNA, 103 bp, Artificial Sequence
  Synthetic Polynucleotide
taatacgactcactatagggatgagttctttcatgtatttgaaaggaactaacagaggagaagttccatgcaaatacataacctggcggcagcgcaaaagatg

SEQ ID NO: 242661 - DNA, 103 bp, Artificial Sequence
  Synthetic Polynucleotide
taatacgactcactatagggtctctccagtatgagttctttcatgtatttaacagaggagaaaatacatgaaagaactcaacctggcggcagcgcaaaagatg

SEQ ID NO: 242662 - DNA, 103 bp, Artificial Sequence
  Synthetic Polynucleotide
taatacgactcactatagggtcataaggtttctctccagtatgagttcttaacagaggagaaagaacatgtactggagaaacctggcggcagcgcaaaagatg

SEQ ID NO: 242663 - DNA, 103 bp, Artificial Sequence
  Synthetic Polynucleotide
taatacgactcactatagggttccttacattcataaggtttctctccagtaacagaggagaactggaatgaaaccttataacctggcggcagcgcaaaagatg

SEQ ID NO: 242664 - DNA, 103 bp, Artificial Sequence
  Synthetic Polynucleotide
taatacgactcactatagggccttcccacattccttacattcataaggttaacagaggagaaaccttatgaatgtaaggaacctggcggcagcgcaaaagatg

SEQ ID NO: 242665 - DNA, 103 bp, Artificial Sequence
  Synthetic Polynucleotide
taatacgactcactatagggttcttctgagagggacccagcaaagcccacaacagaggagagtgggcatggctgggtccaacctggcggcagcgcaaaagatg

SEQ ID NO: 242666 - DNA, 103 bp, Artificial Sequence
  Synthetic Polynucleotide
taatacgactcactatagggtaaatgaaggccttcccacattccttacataacagaggagaatgtaaatgatgtgggaaaacctggcggcagcgcaaaagatg

SEQ ID NO: 242667 - DNA, 103 bp, Artificial Sequence
  Synthetic Polynucleotide
taatacgactcactatagggggttgtgtgataaatgaaggccttcccacaaacagaggagatgtgggatggccttcattaacctggcggcagcgcaaaagatg

SEQ ID NO: 242668 - DNA, 103 bp, Artificial Sequence
  Synthetic Polynucleotide
taatacgactcactataggggtcctcgaaaggttgtgtgataaatgaaggaacagaggagaccttcaatgatcacacaaaacctggcggcagcgcaaaagatg

SEQ ID NO: 242669 - DNA, 103 bp, Artificial Sequence
  Synthetic Polynucleotide
taatacgactcactatagggattctcatgtgtcctcgaaaggttgtgtgaaacagaggagatcacacatgctttcgaggaacctggcggcagcgcaaaagatg

SEQ ID NO: 242670 - DNA, 103 bp, Artificial Sequence
  Synthetic Polynucleotide
taatacgactcactatagggccctgtgtgcattctcatgtgtcctcgaaaaacagaggagatttcgaatgcacatgagaaacctggcggcagcgcaaaagatg

SEQ ID NO: 242671 - DNA, 103 bp, Artificial Sequence
  Synthetic Polynucleotide
taatacgactcactatagggagggtttctcccctgtgtgcattctcatgtaacagaggagaacatgaatgtgcacacagaacctggcggcagcgcaaaagatg

SEQ ID NO: 242672 - DNA, 103 bp, Artificial Sequence
  Synthetic Polynucleotide
taatacgactcactatagggttacatttatagggtttctcccctgtgtgcaacagaggagagcacacatgggagaaaccaacctggcggcagcgcaaaagatg

SEQ ID NO: 242673 - DNA, 103 bp, Artificial Sequence
  Synthetic Polynucleotide
taatacgactcactatagggcccgcattctttacatttatagggtttctcaacagaggagagagaaaatgtataaatgtaacctggcggcagcgcaaaagatg

SEQ ID NO: 242674 - DNA, 103 bp, Artificial Sequence
  Synthetic Polynucleotide
taatacgactcactatagggtgaacgttttcccgcattctttacatttataacagaggagaataaatatgaagaatgcgaacctggcggcagcgcaaaagatg

SEQ ID NO: 242675 - DNA, 103 bp, Artificial Sequence
  Synthetic Polynucleotide
taatacgactcactatagggctgggatgactgaacgttttcccgcattctaacagaggagaagaatgatggaaaacgttaacctggcggcagcgcaaaagatg

SEQ ID NO: 242676 - DNA, 103 bp, Artificial Sequence
  Synthetic Polynucleotide
taatacgactcactatagggtctgtagagtttcttctgagagggacccagaacagaggagactgggtatgtctcagaagaacctggcggcagcgcaaaagatg

SEQ ID NO: 242677 - DNA, 103 bp, Artificial Sequence
  Synthetic Polynucleotide
taatacgactcactatagggtcgaaaagaactgggatgactgaacgttttaacagaggagaaaaacgatgagtcatcccaacctggcggcagcgcaaaagatg

SEQ ID NO: 242678 - DNA, 103 bp, Artificial Sequence
  Synthetic Polynucleotide
taatacgactcactatagggtttcatgatttcgaaaagaactgggatgacaacagaggagagtcatcatggttcttttcaacctggcggcagcgcaaaagatg

SEQ ID NO: 242679 - DNA, 103 bp, Artificial Sequence
  Synthetic Polynucleotide
taatacgactcactataggggagtgagttctttcatgatttcgaaaagaaaacagaggagattctttatgaaatcatgaaacctggcggcagcgcaaaagatg

SEQ ID NO: 242680 - DNA, 103 bp, Artificial Sequence
  Synthetic Polynucleotide
taatacgactcactatagggtttctctccagagtgagttctttcatgattaacagaggagaaatcatatgagaactcacaacctggcggcagcgcaaaagatg

SEQ ID NO: 242681 - DNA, 103 bp, Artificial Sequence
  Synthetic Polynucleotide
taatacgactcactatagggattcatagggtttctctccagagtgagttcaacagaggagagaactcatgctggagagaaacctggcggcagcgcaaaagatg

SEQ ID NO: 242682 - DNA, 103 bp, Artificial Sequence
  Synthetic Polynucleotide
taatacgactcactatagggcattgtttacattcatagggtttctctccaaacagaggagatggagaatgaccctatgaaacctggcggcagcgcaaaagatg

SEQ ID NO: 242683 - DNA, 103 bp, Artificial Sequence
  Synthetic Polynucleotide
taatacgactcactatagggagcttttccacattgtttacattcatagggaacagaggagaccctatatgtgtaaacaaaacctggcggcagcgcaaaagatg

SEQ ID NO: 242684 - DNA, 103 bp, Artificial Sequence
  Synthetic Polynucleotide
taatacgactcactatagggaatatctgaaagcttttccacattgtttacaacagaggagagtaaacatggtggaaaagaacctggcggcagcgcaaaagatg

SEQ ID NO: 242685 - DNA, 103 bp, Artificial Sequence
  Synthetic Polynucleotide
taatacgactcactatagggaaagtttggtaatatctgaaagcttttccaaacagaggagatggaaaatgtttcagataaacctggcggcagcgcaaaagatg

SEQ ID NO: 242686 - DNA, 103 bp, Artificial Sequence
  Synthetic Polynucleotide
taatacgactcactatagggatgtatttgaaaagtttggtaatatctgaaaacagaggagattcagaatgtaccaaactaacctggcggcagcgcaaaagatg

SEQ ID NO: 242687 - DNA, 103 bp, Artificial Sequence
  Synthetic Polynucleotide
taatacgactcactataggggcatcacatctctgtagagtttcttctgagaacagaggagactcagaatgaactctacaaacctggcggcagcgcaaaagatg

SEQ ID NO: 242688 - DNA, 103 bp, Artificial Sequence
  Synthetic Polynucleotide
taatacgactcactataggggagtcctttcatgtatttgaaaagtttggtaacagaggagaaccaaaatgttcaaatacaacctggcggcagcgcaaaagatg

SEQ ID NO: 242689 - DNA, 103 bp, Artificial Sequence
  Synthetic Polynucleotide
taatacgactcactatagggtccccagtgtgagtcctttcatgtatttgaaacagaggagatcaaatatgtgaaaggacaacctggcggcagcgcaaaagatg

SEQ ID NO: 242690 - DNA, 103 bp, Artificial Sequence
  Synthetic Polynucleotide
taatacgactcactatagggatagggtttttccccagtgtgagtcctttcaacagaggagagaaaggatgcacactgggaacctggcggcagcgcaaaagatg

SEQ ID NO: 242691 - DNA, 103 bp, Artificial Sequence
  Synthetic Polynucleotide
taatacgactcactataggggcttacactgatagggtttttccccagtgtaacagaggagaacactgatgaaaaaccctaacctggcggcagcgcaaaagatg

SEQ ID NO: 242692 - DNA, 103 bp, Artificial Sequence
  Synthetic Polynucleotide
taatacgactcactatagggttaccacattgcttacactgatagggttttaacagaggagaaaaaccatgtcagtgtaaaacctggcggcagcgcaaaagatg

SEQ ID NO: 242693 - DNA, 103 bp, Artificial Sequence
  Synthetic Polynucleotide
taatacgactcactatagggactaagagctttaccacattgcttacactgaacagaggagacagtgtatgcaatgtggtaacctggcggcagcgcaaaagatg

SEQ ID NO: 242694 - DNA, 103 bp, Artificial Sequence
  Synthetic Polynucleotide
taatacgactcactatagggatgtgggacaactaagagctttaccacattaacagaggagaaatgtgatgaagctcttaaacctggcggcagcgcaaaagatg

SEQ ID NO: 242695 - DNA, 103 bp, Artificial Sequence
  Synthetic Polynucleotide
taatacgactcactatagggcttcgaaaggatgtgggacaactaagagctaacagaggagaagctctatgttgtcccacaacctggcggcagcgcaaaagatg

SEQ ID NO: 242696 - DNA, 103 bp, Artificial Sequence
  Synthetic Polynucleotide
taatacgactcactatagggcctttcatgacttcgaaaggatgtgggacaaacagaggagatgtcccatgtcctttcgaaacctggcggcagcgcaaaagatg

SEQ ID NO: 242697 - DNA, 103 bp, Artificial Sequence
  Synthetic Polynucleotide
taatacgactcactatagggcagtgtgaatcctttcatgacttcgaaaggaacagaggagacctttcatggtcatgaaaaacctggcggcagcgcaaaagatg

SEQ ID NO: 242698 - DNA, 103 bp, Artificial Sequence
  Synthetic Polynucleotide
taatacgactcactatagggaaggtttcttgcatcacatctctgtagagtaacagaggagaactctaatgagatgtgataacctggcggcagcgcaaaagatg

SEQ ID NO: 242699 - DNA, 103 bp, Artificial Sequence
  Synthetic Polynucleotide
taatacgactcactatagggggtttttctccagtgtgaatcctttcatgaaacagaggagatcatgaatggattcacacaacctggcggcagcgcaaaagatg

SEQ ID NO: 242700 - DNA, 103 bp, Artificial Sequence
  Synthetic Polynucleotide
taatacgactcactatagggacatttatagggtttttctccagtgtgaataacagaggagaattcacatgggagaaaaaaacctggcggcagcgcaaaagatg

SEQ ID NO: 242701 - DNA, 103 bp, Artificial Sequence
  Synthetic Polynucleotide
taatacgactcactatagggcacattttttacatttatagggtttttctcaacagaggagagagaaaatgcctataaataacctggcggcagcgcaaaagatg

SEQ ID NO: 242702 - DNA, 103 bp, Artificial Sequence
  Synthetic Polynucleotide
taatacgactcactatagggaaggctttcccacattttttacatttatagaacagaggagactataaatgtaaaaaatgaacctggcggcagcgcaaaagatg

SEQ ID NO: 242703 - DNA, 103 bp, Artificial Sequence
  Synthetic Polynucleotide
taatacgactcactatagggaggaaaactgaaggctttcccacattttttaacagaggagaaaaaaaatggggaaagccaacctggcggcagcgcaaaagatg

SEQ ID NO: 242704 - DNA, 103 bp, Artificial Sequence
  Synthetic Polynucleotide
taatacgactcactatagggtaaaggaactaggaaaactgaaggctttccaacagaggagaggaaagatgtcagttttcaacctggcggcagcgcaaaagatg

SEQ ID NO: 242705 - DNA, 103 bp, Artificial Sequence
  Synthetic Polynucleotide
taatacgactcactatagggtcatgttttctaaaggaactaggaaaactgaacagaggagacagtttatgtagttccttaacctggcggcagcgcaaaagatg

SEQ ID NO: 242706 - DNA, 103 bp, Artificial Sequence
  Synthetic Polynucleotide
taatacgactcactatagggatgaattctttcatgttttctaaaggaactaacagaggagaagttccatgagaaaacataacctggcggcagcgcaaaagatg

SEQ ID NO: 242707 - DNA, 103 bp, Artificial Sequence
  Synthetic Polynucleotide
taatacgactcactatagggtctctcctgtatgaattctttcatgttttcaacagaggagagaaaacatgaaagaattcaacctggcggcagcgcaaaagatg

SEQ ID NO: 242708 - DNA, 103 bp, Artificial Sequence
  Synthetic Polynucleotide
taatacgactcactatagggtcatagggtttctctcctgtatgaattcttaacagaggagaaagaatatgtacaggagaaacctggcggcagcgcaaaagatg

SEQ ID NO: 242709 - DNA, 103 bp, Artificial Sequence
  Synthetic Polynucleotide
taatacgactcactatagggcaatccaagacttccaccgcctgaatccataacagaggagaatggatatgggcggtggaaacctggcggcagcgcaaaagatg

SEQ ID NO: 242710 - DNA, 103 bp, Artificial Sequence
  Synthetic Polynucleotide
taatacgactcactatagggatggtctccatcgatatgtgcagtaccagcaacagaggagagctggtatggcacatatcaacctggcggcagcgcaaaagatg

SEQ ID NO: 242711 - DNA, 103 bp, Artificial Sequence
  Synthetic Polynucleotide
taatacgactcactatagggaaggtactgtgctgctgtactacttctgctaacagaggagaagcagaatgagtacagcaaacctggcggcagcgcaaaagatg

SEQ ID NO: 242712 - DNA, 103 bp, Artificial Sequence
  Synthetic Polynucleotide
taatacgactcactatagggcacaaatttgaaggtactgtgctgctgtacaacagaggagagtacagatgcacagtaccaacctggcggcagcgcaaaagatg

SEQ ID NO: 242713 - DNA, 103 bp, Artificial Sequence
  Synthetic Polynucleotide
taatacgactcactatagggttaatgccgtcacaaatttgaaggtactgtaacagaggagaacagtaatgtcaaatttgaacctggcggcagcgcaaaagatg

SEQ ID NO: 242714 - DNA, 103 bp, Artificial Sequence
  Synthetic Polynucleotide
taatacgactcactatagggtttatttgtattaatgccgtcacaaatttgaacagaggagacaaattatggacggcattaacctggcggcagcgcaaaagatg

SEQ ID NO: 242715 - DNA, 103 bp, Artificial Sequence
  Synthetic Polynucleotide
taatacgactcactataggggtttaagtactttatttgtattaatgccgtaacagaggagaacggcaatgatacaaataaacctggcggcagcgcaaaagatg

SEQ ID NO: 242716 - DNA, 103 bp, Artificial Sequence
  Synthetic Polynucleotide
taatacgactcactatagggttggctttttgtttaagtactttatttgtaaacagaggagatacaaaatgagtacttaaaacctggcggcagcgcaaaagatg

SEQ ID NO: 242717 - DNA, 103 bp, Artificial Sequence
  Synthetic Polynucleotide
taatacgactcactatagggtctcctctttttggctttttgtttaagtacaacagaggagagtacttatgcaaaaagccaacctggcggcagcgcaaaagatg

SEQ ID NO: 242718 - DNA, 103 bp, Artificial Sequence
  Synthetic Polynucleotide
taatacgactcactatagggtttctccccttctcctctttttggctttttaacagaggagaaaaaagatgaaaagaggaaacctggcggcagcgcaaaagatg

SEQ ID NO: 242719 - DNA, 103 bp, Artificial Sequence
  Synthetic Polynucleotide
taatacgactcactatagggcactgcctggtttctccccttctcctctttaacagaggagaaaagagatgaaggggagaaacctggcggcagcgcaaaagatg

SEQ ID NO: 242720 - DNA, 103 bp, Artificial Sequence
  Synthetic Polynucleotide
taatacgactcactatagggagctgtttgccactgcctggtttctcccctaacagaggagaaggggaatgaccaggcagaacctggcggcagcgcaaaagatg

SEQ ID NO: 242721 - DNA, 103 bp, Artificial Sequence
  Synthetic Polynucleotide
taatacgactcactatagggaaacaacaatatggtctccatcgatatgtgaacagaggagacacataatgatggagaccaacctggcggcagcgcaaaagatg

SEQ ID NO: 242722 - DNA, 103 bp, Artificial Sequence
  Synthetic Polynucleotide
taatacgactcactatagggctattataacagctgtttgccactgcctggaacagaggagaccaggcatgggcaaacagaacctggcggcagcgcaaaagatg

SEQ ID NO: 242723 - DNA, 103 bp, Artificial Sequence
  Synthetic Polynucleotide
taatacgactcactatagggccatcaggacctattataacagctgtttgcaacagaggagagcaaacatgtgttataataacctggcggcagcgcaaaagatg

SEQ ID NO: 242724 - DNA, 103 bp, Artificial Sequence
  Synthetic Polynucleotide
taatacgactcactataggggaggggctgtccatcaggacctattataacaacagaggagagttataatgggtcctgataacctggcggcagcgcaaaagatg

SEQ ID NO: 242725 - DNA, 103 bp, Artificial Sequence
  Synthetic Polynucleotide
taatacgactcactatagggggtacactgtgaggggctgtccatcaggacaacagaggagagtcctgatggacagccccaacctggcggcagcgcaaaagatg

SEQ ID NO: 242726 - DNA, 103 bp, Artificial Sequence
  Synthetic Polynucleotide
taatacgactcactatagggatatggcaagggtacactgtgaggggctgtaacagaggagaacagccatgcacagtgtaaacctggcggcagcgcaaaagatg

SEQ ID NO: 242727 - DNA, 103 bp, Artificial Sequence
  Synthetic Polynucleotide
taatacgactcactatagggttttgtgcaaatatggcaagggtacactgtaacagaggagaacagtgatgccttgccataacctggcggcagcgcaaaagatg

SEQ ID NO: 242728 - DNA, 103 bp, Artificial Sequence
  Synthetic Polynucleotide
taatacgactcactatagggatttaaacttttttgtgcaaatatggcaagaacagaggagacttgccatgtttgcacaaaacctggcggcagcgcaaaagatg

SEQ ID NO: 242729 - DNA, 103 bp, Artificial Sequence
  Synthetic Polynucleotide
taatacgactcactatagggaatcccctggatttaaacttttttgtgcaaaacagaggagattgcacatgaaagtttaaaacctggcggcagcgcaaaagatg

SEQ ID NO: 242730 - DNA, 103 bp, Artificial Sequence
  Synthetic Polynucleotide
taatacgactcactatagggtctttttaagaatcccctggatttaaacttaacagaggagaaagtttatgtccaggggaaacctggcggcagcgcaaaagatg

SEQ ID NO: 242731 - DNA, 103 bp, Artificial Sequence
  Synthetic Polynucleotide
taatacgactcactatagggtcttcatgtgtctttttaagaatcccctggaacagaggagaccagggatgtcttaaaaaaacctggcggcagcgcaaaagatg

SEQ ID NO: 242732 - DNA, 103 bp, Artificial Sequence
  Synthetic Polynucleotide
taatacgactcactatagggtcaggaactgaaacaacaatatggtctccaaacagaggagatggagaatgtattgttgtaacctggcggcagcgcaaaagatg

SEQ ID NO: 242733 - DNA, 103 bp, Artificial Sequence
  Synthetic Polynucleotide
taatacgactcactatagggtcaggatgattcttcatgtgtctttttaagaacagaggagacttaaaatgacacatgaaaacctggcggcagcgcaaaagatg

SEQ ID NO: 242734 - DNA, 103 bp, Artificial Sequence
  Synthetic Polynucleotide
taatacgactcactatagggcattaaatgatcaggatgattcttcatgtgaacagaggagacacatgatgaatcatcctaacctggcggcagcgcaaaagatg

SEQ ID NO: 242735 - DNA, 103 bp, Artificial Sequence
  Synthetic Polynucleotide
taatacgactcactatagggatttttttctcattaaatgatcaggatgataacagaggagaatcatcatgatcatttaaaacctggcggcagcgcaaaagatg

SEQ ID NO: 242736 - DNA, 103 bp, Artificial Sequence
  Synthetic Polynucleotide
taatacgactcactataggggtacactgatatttttttctcattaaatgaaacagaggagatcatttatggagaaaaaaaacctggcggcagcgcaaaagatg

SEQ ID NO: 242737 - DNA, 103 bp, Artificial Sequence
  Synthetic Polynucleotide
taatacgactcactataggggtcacaatctgtacactgatatttttttctaacagaggagaagaaaaatgtatcagtgtaacctggcggcagcgcaaaagatg

SEQ ID NO: 242738 - DNA, 103 bp, Artificial Sequence
  Synthetic Polynucleotide
taatacgactcactatagggtagttgtaaagtcacaatctgtacactgataacagaggagaatcagtatgcagattgtgaacctggcggcagcgcaaaagatg

SEQ ID NO: 242739 - DNA, 103 bp, Artificial Sequence
  Synthetic Polynucleotide
taatacgactcactatagggactttcttgttagttgtaaagtcacaatctaacagaggagaagattgatgctttacaacaacctggcggcagcgcaaaagatg

SEQ ID NO: 242740 - DNA, 103 bp, Artificial Sequence
  Synthetic Polynucleotide
taatacgactcactatagggatggaaactcactttcttgttagttgtaaaaacagaggagatttacaatgaacaagaaaaacctggcggcagcgcaaaagatg

SEQ ID NO: 242741 - DNA, 103 bp, Artificial Sequence
  Synthetic Polynucleotide
taatacgactcactatagggctaagtggttatggaaactcactttcttgtaacagaggagaacaagaatgtgagtttccaacctggcggcagcgcaaaagatg

SEQ ID NO: 242742 - DNA, 103 bp, Artificial Sequence
  Synthetic Polynucleotide
taatacgactcactatagggttatggctttctaagtggttatggaaactcaacagaggagagagtttatgtaaccacttaacctggcggcagcgcaaaagatg

SEQ ID NO: 242743 - DNA, 103 bp, Artificial Sequence
  Synthetic Polynucleotide
taatacgactcactatagggtaaaacagcttcaggaactgaaacaacaataacagaggagaattgttatgtcagttcctaacctggcggcagcgcaaaagatg

SEQ ID NO: 242744 - DNA, 103 bp, Artificial Sequence
  Synthetic Polynucleotide
taatacgactcactataggggtttatgagcttatggctttctaagtggttaacagaggagaaaccacatggaaagccataacctggcggcagcgcaaaagatg

SEQ ID NO: 242745 - DNA, 103 bp, Artificial Sequence
  Synthetic Polynucleotide
taatacgactcactatagggtgtcgactttgtttatgagcttatggctttaacagaggagaaaagccatgagctcataaaacctggcggcagcgcaaaagatg

SEQ ID NO: 242746 - DNA, 103 bp, Artificial Sequence
  Synthetic Polynucleotide
taatacgactcactatagggtcatgggttttgtcgactttgtttatgagcaacagaggagagctcatatgcaaagtcgaaacctggcggcagcgcaaaagatg

SEQ ID NO: 242747 - DNA, 103 bp, Artificial Sequence
  Synthetic Polynucleotide
taatacgactcactatagggttctgtaaattcatgggttttgtcgactttaacagaggagaaaagtcatgaaaacccataacctggcggcagcgcaaaagatg

SEQ ID NO: 242748 - DNA, 103 bp, Artificial Sequence
  Synthetic Polynucleotide
taatacgactcactatagggttcgtgtgtattctgtaaattcatgggtttaacagaggagaaaacccatgaatttacagaacctggcggcagcgcaaaagatg

SEQ ID NO: 242749 - DNA, 103 bp, Artificial Sequence
  Synthetic Polynucleotide
taatacgactcactatagggtctctgtatcttcgtgtgtattctgtaaataacagaggagaatttacatgatacacacgaacctggcggcagcgcaaaagatg

SEQ ID NO: 242750 - DNA, 103 bp, Artificial Sequence
  Synthetic Polynucleotide
taatacgactcactatagggtggactagcctctctgtatcttcgtgtgtaaacagaggagatacacaatgagatacagaaacctggcggcagcgcaaaagatg

SEQ ID NO: 242751 - DNA, 103 bp, Artificial Sequence
  Synthetic Polynucleotide
taatacgactcactatagggtggaactcagtggactagcctctctgtatcaacagaggagagatacaatgaggctagtcaacctggcggcagcgcaaaagatg

SEQ ID NO: 242752 - DNA, 103 bp, Artificial Sequence
  Synthetic Polynucleotide
taatacgactcactatagggataagtttattggaactcagtggactagccaacagaggagaggctagatgactgagttcaacctggcggcagcgcaaaagatg

SEQ ID NO: 242753 - DNA, 103 bp, Artificial Sequence
  Synthetic Polynucleotide
taatacgactcactataggggtctcttaaaataagtttattggaactcagaacagaggagactgagtatgaataaacttaacctggcggcagcgcaaaagatg

SEQ ID NO: 242754 - DNA, 103 bp, Artificial Sequence
  Synthetic Polynucleotide
taatacgactcactatagggcatcagaaactaaaacagcttcaggaactgaacagaggagacagttcatgaagctgtttaacctggcggcagcgcaaaagatg

SEQ ID NO: 242755 - DNA, 103 bp, Artificial Sequence
  Synthetic Polynucleotide
taatacgactcactatagggtcggctccttgtctcttaaaataagtttataacagaggagaataaacatgttttaagagaacctggcggcagcgcaaaagatg

SEQ ID NO: 242756 - DNA, 103 bp, Artificial Sequence
  Synthetic Polynucleotide
taatacgactcactatagggttgtgcatcttcggctccttgtctcttaaaaacagaggagatttaagatgcaaggagccaacctggcggcagcgcaaaagatg

SEQ ID NO: 242757 - DNA, 103 bp, Artificial Sequence
  Synthetic Polynucleotide
taatacgactcactataggggtatttgcacttgtgcatcttcggctccttaacagaggagaaaggagatgaagatgcacaacctggcggcagcgcaaaagatg

SEQ ID NO: 242758 - DNA, 103 bp, Artificial Sequence
  Synthetic Polynucleotide
taatacgactcactatagggcatagtcacagtatttgcacttgtgcatctaacagaggagaagatgcatgagtgcaaataacctggcggcagcgcaaaagatg

SEQ ID NO: 242759 - DNA, 103 bp, Artificial Sequence
  Synthetic Polynucleotide
taatacgactcactatagggtctgcagtttcatagtcacagtatttgcacaacagaggagagtgcaaatgctgtgactaaacctggcggcagcgcaaaagatg

SEQ ID NO: 242760 - DNA, 103 bp, Artificial Sequence
  Synthetic Polynucleotide
taatacgactcactatagggcagtccttgttctgcagtttcatagtcacaaacagaggagatgtgacatggaaactgcaaacctggcggcagcgcaaaagatg

SEQ ID NO: 242761 - DNA, 103 bp, Artificial Sequence
  Synthetic Polynucleotide
taatacgactcactataggggcctgtttaacagtccttgttctgcagtttaacagaggagaaaactgatgaacaaggacaacctggcggcagcgcaaaagatg

SEQ ID NO: 242762 - DNA, 103 bp, Artificial Sequence
  Synthetic Polynucleotide
taatacgactcactataggggccaacaaatgcctgtttaacagtccttgtaacagaggagaacaaggatggttaaacagaacctggcggcagcgcaaaagatg

SEQ ID NO: 242763 - DNA, 103 bp, Artificial Sequence
  Synthetic Polynucleotide
taatacgactcactataggggctgtgaacggccaacaaatgcctgtttaaaacagaggagattaaacatgcatttgttgaacctggcggcagcgcaaaagatg

SEQ ID NO: 242764 - DNA, 103 bp, Artificial Sequence
  Synthetic Polynucleotide
taatacgactcactataggggaaaattcttgctgtgaacggccaacaaataacagaggagaatttgtatgccgttcacaaacctggcggcagcgcaaaagatg

SEQ ID NO: 242765 - DNA, 103 bp, Artificial Sequence
  Synthetic Polynucleotide
taatacgactcactatagggtctgtgacaacatcagaaactaaaacagctaacagaggagaagctgtatgagtttctgaaacctggcggcagcgcaaaagatg

SEQ ID NO: 242766 - DNA, 103 bp, Artificial Sequence
  Synthetic Polynucleotide
taatacgactcactatagggcaaacatgaggaaaattcttgctgtgaacgaacagaggagacgttcaatgcaagaatttaacctggcggcagcgcaaaagatg

SEQ ID NO: 242767 - DNA, 103 bp, Artificial Sequence
  Synthetic Polynucleotide
taatacgactcactatagggacactcaacacaaacatgaggaaaattcttaacagaggagaaagaatatgcctcatgttaacctggcggcagcgcaaaagatg

SEQ ID NO: 242768 - DNA, 103 bp, Artificial Sequence
  Synthetic Polynucleotide
taatacgactcactatagggaacccttcccacactcaacacaaacatgagaacagaggagactcatgatggtgttgagtaacctggcggcagcgcaaaagatg

SEQ ID NO: 242769 - DNA, 103 bp, Artificial Sequence
  Synthetic Polynucleotide
taatacgactcactatagggggatgtcgaaaacccttcccacactcaacaaacagaggagatgttgaatgtgggaagggaacctggcggcagcgcaaaagatg

SEQ ID NO: 242770 - DNA, 103 bp, Artificial Sequence
  Synthetic Polynucleotide
taatacgactcactataggggagttcagaaggatgtcgaaaacccttcccaacagaggagagggaagatgtttcgacataacctggcggcagcgcaaaagatg

SEQ ID NO: 242771 - DNA, 103 bp, Artificial Sequence
  Synthetic Polynucleotide
taatacgactcactatagggtatgtttcttgagttcagaaggatgtcgaaaacagaggagattcgacatgcttctgaacaacctggcggcagcgcaaaagatg

SEQ ID NO: 242772 - DNA, 103 bp, Artificial Sequence
  Synthetic Polynucleotide
taatacgactcactatagggtgggttctcatatgtttcttgagttcagaaaacagaggagattctgaatgcaagaaacaaacctggcggcagcgcaaaagatg

SEQ ID NO: 242773 - DNA, 103 bp, Artificial Sequence
  Synthetic Polynucleotide
taatacgactcactatagggctcaccagtatgggttctcatatgtttcttaacagaggagaaagaaaatgatgagaaccaacctggcggcagcgcaaaagatg

SEQ ID NO: 242774 - DNA, 103 bp, Artificial Sequence
  Synthetic Polynucleotide
taatacgactcactataggggatatggcttctcaccagtatgggttctcaaacagaggagatgagaaatgatactggtgaacctggcggcagcgcaaaagatg

SEQ ID NO: 242775 - DNA, 103 bp, Artificial Sequence
  Synthetic Polynucleotide
taatacgactcactatagggtactgacactgatatggcttctcaccagtaaacagaggagatactggatggaagccataaacctggcggcagcgcaaaagatg

SEQ ID NO: 242776 - DNA, 103 bp, Artificial Sequence
  Synthetic Polynucleotide
taatacgactcactatagggtatcccatcatctgtgacaacatcagaaacaacagaggagagtttctatggttgtcacaaacctggcggcagcgcaaaagatg

SEQ ID NO: 242777 - DNA, 103 bp, Artificial Sequence
  Synthetic Polynucleotide
taatacgactcactataggggaaaatacaatactgacactgatatggcttaacagaggagaaagccaatgcagtgtcagaacctggcggcagcgcaaaagatg

SEQ ID NO: 242778 - DNA, 103 bp, Artificial Sequence
  Synthetic Polynucleotide
taatacgactcactatagggctgcacacctgaaaatacaatactgacactaacagaggagaagtgtcatgattgtatttaacctggcggcagcgcaaaagatg

SEQ ID NO: 242779 - DNA, 103 bp, Artificial Sequence
  Synthetic Polynucleotide
taatacgactcactatagggtttgattgatctgcacacctgaaaatacaaaacagaggagattgtatatgcaggtgtgcaacctggcggcagcgcaaaagatg

SEQ ID NO: 242780 - DNA, 103 bp, Artificial Sequence
  Synthetic Polynucleotide
taatacgactcactatagggagttttcagatttgattgatctgcacacctaacagaggagaaggtgtatggatcaatcaaacctggcggcagcgcaaaagatg

SEQ ID NO: 242781 - DNA, 103 bp, Artificial Sequence
  Synthetic Polynucleotide
taatacgactcactatagggacttaatgtgagttttcagatttgattgataacagaggagaatcaatatgatctgaaaaaacctggcggcagcgcaaaagatg

SEQ ID NO: 242782 - DNA, 103 bp, Artificial Sequence
  Synthetic Polynucleotide
taatacgactcactatagggccatgtttagacttaatgtgagttttcagaaacagaggagatctgaaatgtcacattaaaacctggcggcagcgcaaaagatg

SEQ ID NO: 242783 - DNA, 103 bp, Artificial Sequence
  Synthetic Polynucleotide
taatacgactcactatagggcaaattgttaccatgtttagacttaatgtgaacagaggagacacattatgtctaaacataacctggcggcagcgcaaaagatg

SEQ ID NO: 242784 - DNA, 103 bp, Artificial Sequence
  Synthetic Polynucleotide
taatacgactcactatagggatttatatggcaaattgttaccatgtttagaacagaggagactaaacatggtaacaattaacctggcggcagcgcaaaagatg

SEQ ID NO: 242785 - DNA, 103 bp, Artificial Sequence
  Synthetic Polynucleotide
taatacgactcactatagggcaatgctcacatttatatggcaaattgttaaacagaggagataacaaatggccatataaaacctggcggcagcgcaaaagatg

SEQ ID NO: 242786 - DNA, 103 bp, Artificial Sequence
  Synthetic Polynucleotide
taatacgactcactatagggtgcttggggacaatgctcacatttatatggaacagaggagaccatatatgtgtgagcataacctggcggcagcgcaaaagatg

SEQ ID NO: 242787 - DNA, 103 bp, Artificial Sequence
  Synthetic Polynucleotide
taatacgactcactataggggatcaagagttatcccatcatctgtgacaaaacagaggagattgtcaatgatgatgggaaacctggcggcagcgcaaaagatg

SEQ ID NO: 242788 - DNA, 103 bp, Artificial Sequence
  Synthetic Polynucleotide
taatacgactcactatagggcatcaccaaatgcttggggacaatgctcacaacagaggagagtgagcatggtccccaagaacctggcggcagcgcaaaagatg

SEQ ID NO: 242789 - DNA, 103 bp, Artificial Sequence
  Synthetic Polynucleotide
taatacgactcactatagggagctccctctcatcaccaaatgcttggggaaacagaggagatccccaatgatttggtgaaacctggcggcagcgcaaaagatg

SEQ ID NO: 242790 - DNA, 103 bp, Artificial Sequence
  Synthetic Polynucleotide
taatacgactcactatagggatggcgttgaagctccctctcatcaccaaaaacagaggagatttggtatggagagggagaacctggcggcagcgcaaaagatg

SEQ ID NO: 242791 - DNA, 103 bp, Artificial Sequence
  Synthetic Polynucleotide
taatacgactcactatagggacaaatccagatggcgttgaagctccctctaacagaggagaagagggatgttcaacgccaacctggcggcagcgcaaaagatg

SEQ ID NO: 242792 - DNA, 103 bp, Artificial Sequence
  Synthetic Polynucleotide
taatacgactcactatagggtgtccttgaaacaaatccagatggcgttgaaacagaggagatcaacgatgtctggatttaacctggcggcagcgcaaaagatg

SEQ ID NO: 242793 - DNA, 103 bp, Artificial Sequence
  Synthetic Polynucleotide
taatacgactcactataggggtgtgtcttatgtccttgaaacaaatccagaacagaggagactggatatgtttcaaggaaacctggcggcagcgcaaaagatg

SEQ ID NO: 242794 - DNA, 103 bp, Artificial Sequence
  Synthetic Polynucleotide
taatacgactcactataggggaggacactggtgtgtcttatgtccttgaaaacagaggagattcaagatgataagacacaacctggcggcagcgcaaaagatg

SEQ ID NO: 242795 - DNA, 103 bp, Artificial Sequence
  Synthetic Polynucleotide
taatacgactcactatagggtggtcacaatgaggacactggtgtgtcttaaacagaggagataagacatgccagtgtccaacctggcggcagcgcaaaagatg

SEQ ID NO: 242796 - DNA, 103 bp, Artificial Sequence
  Synthetic Polynucleotide
taatacgactcactatagggggtgctcttatggtcacaatgaggacactgaacagaggagacagtgtatgcattgtgacaacctggcggcagcgcaaaagatg

SEQ ID NO: 242797 - DNA, 103 bp, Artificial Sequence
  Synthetic Polynucleotide
taatacgactcactatagggcacttgaattggtgctcttatggtcacaataacagaggagaattgtgatgataagagcaaacctggcggcagcgcaaaagatg

SEQ ID NO: 242798 - DNA, 103 bp, Artificial Sequence
  Synthetic Polynucleotide
taatacgactcactataggggcaaggccatgatcaagagttatcccatcaaacagaggagatgatggatgaactcttgaaacctggcggcagcgcaaaagatg

SEQ ID NO: 242799 - DNA, 103 bp, Artificial Sequence
  Synthetic Polynucleotide
taatacgactcactatagggcgcttaaggtcacttgaattggtgctcttaaacagaggagataagagatgcaattcaagaacctggcggcagcgcaaaagatg

SEQ ID NO: 242800 - DNA, 103 bp, Artificial Sequence
  Synthetic Polynucleotide
taatacgactcactatagggtatgatgtgccgcttaaggtcacttgaattaacagaggagaaattcaatggaccttaagaacctggcggcagcgcaaaagatg

SEQ ID NO: 242801 - DNA, 103 bp, Artificial Sequence
  Synthetic Polynucleotide
taatacgactcactatagggtatggacagatatgatgtgccgcttaaggtaacagaggagaaccttaatgggcacatcaaacctggcggcagcgcaaaagatg

SEQ ID NO: 242802 - DNA, 103 bp, Artificial Sequence
  Synthetic Polynucleotide
taatacgactcactatagggaaatccttagtatggacagatatgatgtgcaacagaggagagcacatatgatctgtccaaacctggcggcagcgcaaaagatg

SEQ ID NO: 242803 - DNA, 103 bp, Artificial Sequence
  Synthetic Polynucleotide
taatacgactcactatagggtttgtgaggaaaatccttagtatggacagaaacagaggagatctgtcatgactaaggataacctggcggcagcgcaaaagatg

SEQ ID NO: 242804 - DNA, 103 bp, Artificial Sequence
  Synthetic Polynucleotide
taatacgactcactatagggagacctcacatttgtgaggaaaatccttagaacagaggagactaaggatgttcctcacaaacctggcggcagcgcaaaagatg

SEQ ID NO: 242805 - DNA, 103 bp, Artificial Sequence
  Synthetic Polynucleotide
taatacgactcactatagggcctttatcacagacctcacatttgtgaggaaacagaggagatcctcaatgatgtgaggtaacctggcggcagcgcaaaagatg

SEQ ID NO: 242806 - DNA, 103 bp, Artificial Sequence
  Synthetic Polynucleotide
taatacgactcactatagggacgatgaaaacctttatcacagacctcacaaacagaggagatgtgagatgtgtgataaaaacctggcggcagcgcaaaagatg

SEQ ID NO: 242807 - DNA, 103 bp, Artificial Sequence
  Synthetic Polynucleotide
taatacgactcactataggggctcagaaggacgatgaaaacctttatcacaacagaggagagtgataatggttttcatcaacctggcggcagcgcaaaagatg

SEQ ID NO: 242808 - DNA, 103 bp, Artificial Sequence
  Synthetic Polynucleotide
taatacgactcactatagggtgctttttgagctcagaaggacgatgaaaaaacagaggagattttcaatgtccttctgaaacctggcggcagcgcaaaagatg

SEQ ID NO: 242809 - DNA, 103 bp, Artificial Sequence
  Synthetic Polynucleotide
taatacgactcactatagggaacttcagctgcaaggccatgatcaagagtaacagaggagaactcttatgcatggccttaacctggcggcagcgcaaaagatg

SEQ ID NO: 242810 - DNA, 103 bp, Artificial Sequence
  Synthetic Polynucleotide
taatacgactcactataggggatatcactatgctttttgagctcagaaggaacagaggagaccttctatgctcaaaaagaacctggcggcagcgcaaaagatg

SEQ ID NO: 242811 - DNA, 103 bp, Artificial Sequence
  Synthetic Polynucleotide
taatacgactcactatagggtacccttatggatatcactatgctttttgaaacagaggagatcaaaaatgatagtgataaacctggcggcagcgcaaaagatg

SEQ ID NO: 242812 - DNA, 103 bp, Artificial Sequence
  Synthetic Polynucleotide
taatacgactcactatagggtgaatcttcctacccttatggatatcactaaacagaggagatagtgaatgccataagggaacctggcggcagcgcaaaagatg

SEQ ID NO: 242813 - DNA, 103 bp, Artificial Sequence
  Synthetic Polynucleotide
taatacgactcactatagggcctgcactgatgaatcttcctacccttatgaacagaggagacataagatgaggaagattaacctggcggcagcgcaaaagatg

SEQ ID NO: 242814 - DNA, 103 bp, Artificial Sequence
  Synthetic Polynucleotide
taatacgactcactatagggagtcacagtgcctgcactgatgaatcttccaacagaggagaggaagaatgatcagtgcaaacctggcggcagcgcaaaagatg

SEQ ID NO: 242815 - DNA, 103 bp, Artificial Sequence
  Synthetic Polynucleotide
taatacgactcactataggggatgttttaaagtcacagtgcctgcactgaaacagaggagatcagtgatggcactgtgaaacctggcggcagcgcaaaagatg

SEQ ID NO: 242816 - DNA, 103 bp, Artificial Sequence
  Synthetic Polynucleotide
taatacgactcactatagggaaatggatcggatgttttaaagtcacagtgaacagaggagacactgtatgtttaaaacaaacctggcggcagcgcaaaagatg

SEQ ID NO: 242817 - DNA, 103 bp, Artificial Sequence
  Synthetic Polynucleotide
taatacgactcactatagggcactaagaataaatggatcggatgttttaaaacagaggagattaaaaatgccgatccataacctggcggcagcgcaaaagatg

SEQ ID NO: 242818 - DNA, 103 bp, Artificial Sequence
  Synthetic Polynucleotide
taatacgactcactatagggaggatatggccactaagaataaatggatcgaacagaggagacgatccatgtattcttagaacctggcggcagcgcaaaagatg

SEQ ID NO: 242819 - DNA, 103 bp, Artificial Sequence
  Synthetic Polynucleotide
taatacgactcactatagggatgaactgaaaggatatggccactaagaataacagaggagaattcttatgggccatatcaacctggcggcagcgcaaaagatg

SEQ ID NO: 242820 - DNA, 103 bp, Artificial Sequence
  Synthetic Polynucleotide
taatacgactcactatagggctggcgtgtgcaatccaagacttccaccgcaacagaggagagcggtgatggtcttggataacctggcggcagcgcaaaagatg

SEQ ID NO: 242821 - DNA, 103 bp, Artificial Sequence
  Synthetic Polynucleotide
taatacgactcactataggggtccatggacaacttcagctgcaaggccataacagaggagaatggccatgcagctgaagaacctggcggcagcgcaaaagatg

SEQ ID NO: 242822 - DNA, 103 bp, Artificial Sequence
  Synthetic Polynucleotide
taatacgactcactataggggatctttagtatgaactgaaaggatatggcaacagaggagagccataatgtttcagttcaacctggcggcagcgcaaaagatg

SEQ ID NO: 242823 - DNA, 103 bp, Artificial Sequence
  Synthetic Polynucleotide
taatacgactcactatagggttcaatggctgatctttagtatgaactgaaaacagaggagattcagtatgtactaaagaaacctggcggcagcgcaaaagatg

SEQ ID NO: 242824 - DNA, 103 bp, Artificial Sequence
  Synthetic Polynucleotide
taatacgactcactatagggccttttacatttcaatggctgatctttagtaacagaggagaactaaaatgcagccattgaacctggcggcagcgcaaaagatg

SEQ ID NO: 242825 - DNA, 103 bp, Artificial Sequence
  Synthetic Polynucleotide
taatacgactcactatagggctctcttgcaccttttacatttcaatggctaacagaggagaagccatatgaatgtaaaaaacctggcggcagcgcaaaagatg

SEQ ID NO: 242826 - DNA, 103 bp, Artificial Sequence
  Synthetic Polynucleotide
taatacgactcactatagggtgtctgaatcctctcttgcaccttttacataacagaggagaatgtaaatggtgcaagagaacctggcggcagcgcaaaagatg

SEQ ID NO: 242827 - DNA, 103 bp, Artificial Sequence
  Synthetic Polynucleotide
taatacgactcactatagggctcattttgttgtctgaatcctctcttgcaaacagaggagatgcaagatgggattcagaaacctggcggcagcgcaaaagatg

SEQ ID NO: 242828 - DNA, 103 bp, Artificial Sequence
  Synthetic Polynucleotide
taatacgactcactataggggtttttttagctcattttgttgtctgaatcaacagaggagagattcaatgaacaaaatgaacctggcggcagcgcaaaagatg

SEQ ID NO: 242829 - DNA, 103 bp, Artificial Sequence
  Synthetic Polynucleotide
taatacgactcactataggggtcttcatatgtttttttagctcattttgtaacagaggagaacaaaaatggctaaaaaaaacctggcggcagcgcaaaagatg

SEQ ID NO: 242830 - DNA, 103 bp, Artificial Sequence
  Synthetic Polynucleotide
taatacgactcactatagggtccagtatgggtcttcatatgtttttttagaacagaggagactaaaaatgcatatgaagaacctggcggcagcgcaaaagatg

SEQ ID NO: 242831 - DNA, 103 bp, Artificial Sequence
  Synthetic Polynucleotide
taatacgactcactatagggaaatcttccttccagtatgggtcttcatataacagaggagaatatgaatgcccatactgaacctggcggcagcgcaaaagatg

SEQ ID NO: 242832 - DNA, 103 bp, Artificial Sequence
  Synthetic Polynucleotide
taatacgactcactatagggatgatatcaggtccatggacaacttcagctaacagaggagaagctgaatgtgtccatggaacctggcggcagcgcaaaagatg

SEQ ID NO: 242833 - DNA, 103 bp, Artificial Sequence
  Synthetic Polynucleotide
taatacgactcactatagggtcacattggtaaatcttccttccagtatggaacagaggagaccatacatgaaggaagataacctggcggcagcgcaaaagatg

SEQ ID NO: 242834 - DNA, 103 bp, Artificial Sequence
  Synthetic Polynucleotide
taatacgactcactatagggttcacaatactcacattggtaaatcttcctaacagaggagaaggaagatgtaccaatgtaacctggcggcagcgcaaaagatg

SEQ ID NO: 242835 - DNA, 103 bp, Artificial Sequence
  Synthetic Polynucleotide
taatacgactcactatagggtagtgctgtattcacaatactcacattggtaacagaggagaaccaatatgagtattgtgaacctggcggcagcgcaaaagatg

SEQ ID NO: 242836 - DNA, 103 bp, Artificial Sequence
  Synthetic Polynucleotide
taatacgactcactataggggatgcatctgtagtgctgtattcacaatacaacagaggagagtattgatgatacagcacaacctggcggcagcgcaaaagatg

SEQ ID NO: 242837 - DNA, 103 bp, Artificial Sequence
  Synthetic Polynucleotide
taatacgactcactatagggtttaaagccagatgcatctgtagtgctgtaaacagaggagatacagcatgacagatgcaaacctggcggcagcgcaaaagatg

SEQ ID NO: 242838 - DNA, 103 bp, Artificial Sequence
  Synthetic Polynucleotide
taatacgactcactatagggtcacatgtcgtttaaagccagatgcatctgaacagaggagacagatgatgctggctttaaacctggcggcagcgcaaaagatg

SEQ ID NO: 242839 - DNA, 103 bp, Artificial Sequence
  Synthetic Polynucleotide
taatacgactcactatagggtgtattgatatcacatgtcgtttaaagccaaacagaggagatggcttatgacgacatgtaacctggcggcagcgcaaaagatg

SEQ ID NO: 242840 - DNA, 103 bp, Artificial Sequence
  Synthetic Polynucleotide
taatacgactcactataggggtcttttgtatgtattgatatcacatgtcgaacagaggagacgacatatgatatcaataaacctggcggcagcgcaaaagatg

SEQ ID NO: 242841 - DNA, 103 bp, Artificial Sequence
  Synthetic Polynucleotide
taatacgactcactatagggtgtgtggatagtcttttgtatgtattgataaacagaggagatatcaaatgatacaaaagaacctggcggcagcgcaaaagatg

SEQ ID NO: 242842 - DNA, 103 bp, Artificial Sequence
  Synthetic Polynucleotide
taatacgactcactatagggaattcacacctgtgtggatagtcttttgtaaacagaggagatacaaaatgctatccacaaacctggcggcagcgcaaaagatg

SEQ ID NO: 242843 - DNA, 103 bp, Artificial Sequence
  Synthetic Polynucleotide
taatacgactcactatagggagtctctgtgatgatatcaggtccatggacaacagaggagagtccatatgcctgatatcaacctggcggcagcgcaaaagatg

SEQ ID NO: 242844 - DNA, 103 bp, Artificial Sequence
  Synthetic Polynucleotide
taatacgactcactatagggcttcttgcagaattcacacctgtgtggataaacagaggagatatccaatgaggtgtgaaaacctggcggcagcgcaaaagatg

SEQ ID NO: 242845 - DNA, 103 bp, Artificial Sequence
  Synthetic Polynucleotide
taatacgactcactatagggttcggaatcccttcttgcagaattcacaccaacagaggagaggtgtgatgtctgcaagaaacctggcggcagcgcaaaagatg

SEQ ID NO: 242846 - DNA, 103 bp, Artificial Sequence
  Synthetic Polynucleotide
taatacgactcactatagggtctgatggtcttcggaatcccttcttgcagaacagaggagactgcaaatggggattccgaacctggcggcagcgcaaaagatg

SEQ ID NO: 242847 - DNA, 103 bp, Artificial Sequence
  Synthetic Polynucleotide
taatacgactcactatagggctgatttttttctgatggtcttcggaatccaacagaggagaggattcatgagaccatcaaacctggcggcagcgcaaaagatg

SEQ ID NO: 242848 - DNA, 103 bp, Artificial Sequence
  Synthetic Polynucleotide
taatacgactcactatagggtcataatatgctgatttttttctgatggtcaacagaggagagaccatatgaaaaaaatcaacctggcggcagcgcaaaagatg

SEQ ID NO: 242849 - DNA, 103 bp, Artificial Sequence
  Synthetic Polynucleotide
taatacgactcactatagggttgtggtgcctcataatatgctgattttttaacagaggagaaaaaaaatggcatattataacctggcggcagcgcaaaagatg

SEQ ID NO: 242850 - DNA, 103 bp, Artificial Sequence
  Synthetic Polynucleotide
taatacgactcactatagggaagagcctctttgtggtgcctcataatatgaacagaggagacatattatgaggcaccacaacctggcggcagcgcaaaagatg

SEQ ID NO: 242851 - DNA, 103 bp, Artificial Sequence
  Synthetic Polynucleotide
taatacgactcactatagggttactacatcagtctctgtgatgatatcagaacagaggagactgataatgtcacagagaaacctggcggcagcgcaaaagatg

SEQ ID NO: 242852 - DNA, 103 bp, Artificial Sequence
  Synthetic Polynucleotide
taatacgactcactatagggacaccttctgttactacatcagtctctgtgaacagaggagacacagaatgtgatgtagtaacctggcggcagcgcaaaagatg

SEQ ID NO: 242853 - DNA, 103 bp, Artificial Sequence
  Synthetic Polynucleotide
taatacgactcactatagggaggaacaatcacaccttctgttactacatcaacagaggagagatgtaatgacagaaggtaacctggcggcagcgcaaaagatg

SEQ ID NO: 242854 - DNA, 103 bp, Artificial Sequence
  Synthetic Polynucleotide
taatacgactcactataggggtaccgcttcaggaacaatcacaccttctgaacagaggagacagaagatgtgattgttcaacctggcggcagcgcaaaagatg

SEQ ID NO: 242855 - DNA, 103 bp, Artificial Sequence
  Synthetic Polynucleotide
taatacgactcactatagggtcagcttcaagtaccgcttcaggaacaatcaacagaggagagattgtatgtgaagcggtaacctggcggcagcgcaaaagatg

SEQ ID NO: 242856 - DNA, 103 bp, Artificial Sequence
  Synthetic Polynucleotide
taatacgactcactatagggaatggcaacatcagcttcaagtaccgcttcaacagaggagagaagcgatgcttgaagctaacctggcggcagcgcaaaagatg

SEQ ID NO: 242857 - DNA, 103 bp, Artificial Sequence
  Synthetic Polynucleotide
taatacgactcactatagggaatcctcttcaatggcaacatcagcttcaaaacagaggagattgaagatgatgttgccaaacctggcggcagcgcaaaagatg

SEQ ID NO: 242858 - DNA, 103 bp, Artificial Sequence
  Synthetic Polynucleotide
taatacgactcactatagggattctagagtctggcgtgtgcaatccaagaaacagaggagatcttggatggcacacgccaacctggcggcagcgcaaaagatg

SEQ ID NO: 242859 - DNA, 103 bp, Artificial Sequence
  Synthetic Polynucleotide
taatacgactcactatagggtcttcctctaaatcctcttcaatggcaacaaacagaggagatgttgcatgtgaagaggaaacctggcggcagcgcaaaagatg

SEQ ID NO: 242860 - DNA, 103 bp, Artificial Sequence
  Synthetic Polynucleotide
taatacgactcactatagggatcaccatcatcttcctctaaatcctcttcaacagaggagagaagagatgttagaggaaaacctggcggcagcgcaaaagatg

SEQ ID NO: 242861 - DNA, 103 bp, Artificial Sequence
  Synthetic Polynucleotide
taatacgactcactatagggtcaagatgtgatcaccatcatcttcctctaaacagaggagatagaggatgatgatggtgaacctggcggcagcgcaaaagatg

SEQ ID NO: 242862 - DNA, 103 bp, Artificial Sequence
  Synthetic Polynucleotide
taatacgactcactatagggagttcagaagtcaagatgtgatcaccatcaaacagaggagatgatggatgtcacatcttaacctggcggcagcgcaaaagatg

SEQ ID NO: 242863 - DNA, 103 bp, Artificial Sequence
  Synthetic Polynucleotide
taatacgactcactatagggttctgtaattagttcagaagtcaagatgtgaacagaggagacacatcatgacttctgaaaacctggcggcagcgcaaaagatg

SEQ ID NO: 242864 - DNA, 103 bp, Artificial Sequence
  Synthetic Polynucleotide
taatacgactcactatagggccctaacggtttctgtaattagttcagaagaacagaggagacttctgatgtaattacagaacctggcggcagcgcaaaagatg

SEQ ID NO: 242865 - DNA, 103 bp, Artificial Sequence
  Synthetic Polynucleotide
taatacgactcactatagggtgctctggtaccctaacggtttctgtaattaacagaggagaaattacatgaaccgttagaacctggcggcagcgcaaaagatg

SEQ ID NO: 242866 - DNA, 103 bp, Artificial Sequence
  Synthetic Polynucleotide
taatacgactcactatagggcacgaaaacctgctctggtaccctaacggtaacagaggagaaccgttatggtaccagagaacctggcggcagcgcaaaagatg

SEQ ID NO: 242867 - DNA, 103 bp, Artificial Sequence
  Synthetic Polynucleotide
taatacgactcactatagggcaaggtcagccacgaaaacctgctctggtaaacagaggagataccagatgaggttttcgaacctggcggcagcgcaaaagatg

SEQ ID NO: 242868 - DNA, 103 bp, Artificial Sequence
  Synthetic Polynucleotide
taatacgactcactatagggggaccagtaacaaggtcagccacgaaaaccaacagaggagaggttttatgggctgacctaacctggcggcagcgcaaaagatg

SEQ ID NO: 242869 - DNA, 103 bp, Artificial Sequence
  Synthetic Polynucleotide
taatacgactcactatagggggtatgggccattctagagtctggcgtgtgaacagaggagacacacgatggactctagaaacctggcggcagcgcaaaagatg

SEQ ID NO: 242870 - DNA, 103 bp, Artificial Sequence
  Synthetic Polynucleotide
taatacgactcactataggggtgtccattaggaccagtaacaaggtcagcaacagaggagagctgacatggttactggtaacctggcggcagcgcaaaagatg

SEQ ID NO: 242871 - DNA, 103 bp, Artificial Sequence
  Synthetic Polynucleotide
taatacgactcactatagggcatgttctaagtgtccattaggaccagtaaaacagaggagattactgatgctaatggacaacctggcggcagcgcaaaagatg

SEQ ID NO: 242872 - DNA, 103 bp, Artificial Sequence
  Synthetic Polynucleotide
taatacgactcactatagggtcttggaccacatgttctaagtgtccattaaacagaggagataatggatgcttagaacaaacctggcggcagcgcaaaagatg

SEQ ID NO: 242873 - DNA, 103 bp, Artificial Sequence
  Synthetic Polynucleotide
taatacgactcactatagggtgaaacacaatcttggaccacatgttctaaaacagaggagattagaaatggtggtccaaaacctggcggcagcgcaaaagatg

SEQ ID NO: 242874 - DNA, 103 bp, Artificial Sequence
  Synthetic Polynucleotide
taatacgactcactatagggagtcgactcctgaaacacaatcttggaccaaacagaggagatggtccatgattgtgtttaacctggcggcagcgcaaaagatg

SEQ ID NO: 242875 - DNA, 103 bp, Artificial Sequence
  Synthetic Polynucleotide
taatacgactcactatagggattgtgggagagtcgactcctgaaacacaaaacagaggagattgtgtatgaggagtcgaaacctggcggcagcgcaaaagatg

SEQ ID NO: 242876 - DNA, 103 bp, Artificial Sequence
  Synthetic Polynucleotide
taatacgactcactatagggctctgataccattgtgggagagtcgactccaacagaggagaggagtcatgtctcccacaaacctggcggcagcgcaaaagatg

SEQ ID NO: 242877 - DNA, 103 bp, Artificial Sequence
  Synthetic Polynucleotide
taatacgactcactatagggcaagaacctcctctgataccattgtgggagaacagaggagactcccaatgtggtatcagaacctggcggcagcgcaaaagatg

SEQ ID NO: 242878 - DNA, 103 bp, Artificial Sequence
  Synthetic Polynucleotide
taatacgactcactataggggaattagttacaagaacctcctctgataccaacagaggagaggtatcatgggaggttctaacctggcggcagcgcaaaagatg

SEQ ID NO: 242879 - DNA, 103 bp, Artificial Sequence
  Synthetic Polynucleotide
taatacgactcactatagggttctgtatctgaattagttacaagaacctcaacagaggagagaggttatggtaactaataacctggcggcagcgcaaaagatg

SEQ ID NO: 242880 - DNA, 103 bp, Artificial Sequence
  Synthetic Polynucleotide
taatacgactcactataggggcataatcatggtatgggccattctagagtaacagaggagaactctaatgtggcccataaacctggcggcagcgcaaaagatg

SEQ ID NO: 242881 - DNA, 103 bp, Artificial Sequence
  Synthetic Polynucleotide
taatacgactcactataggggaatcacagtttctgtatctgaattagttaaacagaggagataactaatgcagatacagaacctggcggcagcgcaaaagatg

SEQ ID NO: 242882 - DNA, 103 bp, Artificial Sequence
  Synthetic Polynucleotide
taatacgactcactatagggccagctgcttgaatcacagtttctgtatctaacagaggagaagatacatgaactgtgataacctggcggcagcgcaaaagatg

SEQ ID NO: 242883 - DNA, 103 bp, Artificial Sequence
  Synthetic Polynucleotide
taatacgactcactatagggaggaacacctccagctgcttgaatcacagtaacagaggagaactgtgatgcaagcagctaacctggcggcagcgcaaaagatg

SEQ ID NO: 242884 - DNA, 103 bp, Artificial Sequence
  Synthetic Polynucleotide
taatacgactcactatagggctgtagaaccaggaacacctccagctgcttaacagaggagaaagcagatggaggtgttcaacctggcggcagcgcaaaagatg

SEQ ID NO: 242885 - DNA, 103 bp, Artificial Sequence
  Synthetic Polynucleotide
taatacgactcactatagggtttatagtaactgtagaaccaggaacacctaacagaggagaaggtgtatgtggttctacaacctggcggcagcgcaaaagatg

SEQ ID NO: 242886 - DNA, 103 bp, Artificial Sequence
  Synthetic Polynucleotide
taatacgactcactatagggatcttcggtttttatagtaactgtagaaccaacagaggagaggttctatggttactataaacctggcggcagcgcaaaagatg

SEQ ID NO: 242887 - DNA, 103 bp, Artificial Sequence
  Synthetic Polynucleotide
taatacgactcactatagggcatcatcatcatcttcggtttttatagtaaaacagaggagattactaatgaaaccgaagaacctggcggcagcgcaaaagatg

SEQ ID NO: 242888 - DNA, 103 bp, Artificial Sequence
  Synthetic Polynucleotide
taatacgactcactatagggttgacatcatcatcatcatcatcttcggttaacagaggagaaaccgaatgtgatgatgaaacctggcggcagcgcaaaagatg

SEQ ID NO: 242889 - DNA, 103 bp, Artificial Sequence
  Synthetic Polynucleotide
taatacgactcactatagggagaagtgctcttgacatcatcatcatcatcaacagaggagagatgatatggatgatgtcaacctggcggcagcgcaaaagatg

SEQ ID NO: 242890 - DNA, 103 bp, Artificial Sequence
  Synthetic Polynucleotide
taatacgactcactatagggagtagtcttcagaagtgctcttgacatcataacagaggagaatgatgatgagagcacttaacctggcggcagcgcaaaagatg

SEQ ID NO: 242891 - DNA, 103 bp, Artificial Sequence
  Synthetic Polynucleotide
taatacgactcactatagggacaaaatcttgcataatcatggtatgggccaacagaggagaggcccaatgcatgattataacctggcggcagcgcaaaagatg

SEQ ID NO: 242892 - DNA, 103 bp, Artificial Sequence
  Synthetic Polynucleotide
taatacgactcactataggggatatcattaagtagtcttcagaagtgctcaacagaggagagagcacatgtgaagactaaacctggcggcagcgcaaaagatg

SEQ ID NO: 242893 - DNA, 103 bp, Artificial Sequence
  Synthetic Polynucleotide
taatacgactcactatagggatcatccaaagatatcattaagtagtcttcaacagaggagagaagacatgttaatgataaacctggcggcagcgcaaaagatg

SEQ ID NO: 242894 - DNA, 103 bp, Artificial Sequence
  Synthetic Polynucleotide
taatacgactcactatagggtttctccaacatcatccaaagatatcattaaacagaggagataatgaatgctttggatgaacctggcggcagcgcaaaagatg

SEQ ID NO: 242895 - DNA, 103 bp, Artificial Sequence
  Synthetic Polynucleotide
taatacgactcactatagggtgctctaatttttctccaacatcatccaaaaacagaggagatttggaatgtgttggagaaacctggcggcagcgcaaaagatg

SEQ ID NO: 242896 - DNA, 103 bp, Artificial Sequence
  Synthetic Polynucleotide
taatacgactcactatagggattccccatatgctctaatttttctccaacaacagaggagagttggaatgaaattagagaacctggcggcagcgcaaaagatg

SEQ ID NO: 242897 - DNA, 103 bp, Artificial Sequence
  Synthetic Polynucleotide
taatacgactcactatagggttaatggtgtattccccatatgctctaattaacagaggagaaattagatgatatggggaaacctggcggcagcgcaaaagatg

SEQ ID NO: 242898 - DNA, 103 bp, Artificial Sequence
  Synthetic Polynucleotide
taatacgactcactatagggctgccaatttttaatggtgtattccccataaacagaggagatatgggatgtacaccattaacctggcggcagcgcaaaagatg

SEQ ID NO: 242899 - DNA, 103 bp, Artificial Sequence
  Synthetic Polynucleotide
taatacgactcactatagggtgaaccatcactgccaatttttaatggtgtaacagaggagaacaccaatgaaaattggcaacctggcggcagcgcaaaagatg

SEQ ID NO: 242900 - DNA, 103 bp, Artificial Sequence
  Synthetic Polynucleotide
taatacgactcactatagggcatcttcttgtgaaccatcactgccaatttaacagaggagaaaattgatggtgatggttaacctggcggcagcgcaaaagatg

SEQ ID NO: 242901 - DNA, 103 bp, Artificial Sequence
  Synthetic Polynucleotide
taatacgactcactatagggtcttctttagcatcttcttgtgaaccatcaaacagaggagatgatggatgacaagaagaaacctggcggcagcgcaaaagatg

SEQ ID NO: 242902 - DNA, 103 bp, Artificial Sequence
  Synthetic Polynucleotide
taatacgactcactatagggcattccagccacaaaatcttgcataatcataacagaggagaatgattatgcaagattttaacctggcggcagcgcaaaagatg

SEQ ID NO: 242903 - DNA, 103 bp, Artificial Sequence
  Synthetic Polynucleotide
taatacgactcactatagggaccaaacccatcttctttagcatcttcttgaacagaggagacaagaaatggctaaagaaaacctggcggcagcgcaaaagatg

SEQ ID NO: 242904 - DNA, 103 bp, Artificial Sequence
  Synthetic Polynucleotide
taatacgactcactatagggtaacttcagaaccaaacccatcttctttagaacagaggagactaaagatgatgggtttgaacctggcggcagcgcaaaagatg

SEQ ID NO: 242905 - DNA, 103 bp, Artificial Sequence
  Synthetic Polynucleotide
taatacgactcactatagggtacacttttataacttcagaaccaaacccaaacagaggagatgggttatgttctgaagtaacctggcggcagcgcaaaagatg

SEQ ID NO: 242906 - DNA, 103 bp, Artificial Sequence
  Synthetic Polynucleotide
taatacgactcactatagggtttaaatatatacacttttataacttcagaaacagaggagatctgaaatgataaaagtgaacctggcggcagcgcaaaagatg

SEQ ID NO: 242907 - DNA, 103 bp, Artificial Sequence
  Synthetic Polynucleotide
taatacgactcactatagggcagcctccgctttaaatatatacacttttaaacagaggagataaaagatgatatatttaaacctggcggcagcgcaaaagatg

SEQ ID NO: 242908 - DNA, 103 bp, Artificial Sequence
  Synthetic Polynucleotide
taatacgactcactatagggacatcatcttcagcctccgctttaaatataaacagaggagatatattatgagcggaggcaacctggcggcagcgcaaaagatg

SEQ ID NO: 242909 - DNA, 103 bp, Artificial Sequence
  Synthetic Polynucleotide
taatacgactcactatagggacctatttcaacatcatcttcagcctccgcaacagaggagagcggagatggaagatgataacctggcggcagcgcaaaagatg

SEQ ID NO: 242910 - DNA, 103 bp, Artificial Sequence
  Synthetic Polynucleotide
taatacgactcactatagggtttctgttccacctatttcaacatcatcttaacagaggagaaagatgatgttgaaatagaacctggcggcagcgcaaaagatg

SEQ ID NO: 242911 - DNA, 103 bp, Artificial Sequence
  Synthetic Polynucleotide
taatacgactcactatagggtctgtgacaatttctgttccacctatttcaaacagaggagatgaaatatgtggaacagaaacctggcggcagcgcaaaagatg

SEQ ID NO: 242912 - DNA, 103 bp, Artificial Sequence
  Synthetic Polynucleotide
taatacgactcactataggggtactcactctctgtgacaatttctgttccaacagaggagaggaacaatgattgtcacaaacctggcggcagcgcaaaagatg

SEQ ID NO: 242913 - DNA, 103 bp, Artificial Sequence
  Synthetic Polynucleotide
taatacgactcactatagggcagtaccagccattccagccacaaaatcttaacagaggagaaagattatgtggctggaaaacctggcggcagcgcaaaagatg

SEQ ID NO: 242914 - DNA, 103 bp, Artificial Sequence
  Synthetic Polynucleotide
taatacgactcactataggggtccactggtgtactcactctctgtgacaaaacagaggagattgtcaatgagagtgagtaacctggcggcagcgcaaaagatg

SEQ ID NO: 242915 - DNA, 103 bp, Artificial Sequence
  Synthetic Polynucleotide
taatacgactcactataggggctactgaatgtccactggtgtactcactcaacagaggagagagtgaatgcaccagtggaacctggcggcagcgcaaaagatg

SEQ ID NO: 242916 - DNA, 103 bp, Artificial Sequence
  Synthetic Polynucleotide
taatacgactcactatagggaagcactccagctactgaatgtccactggtaacagaggagaaccagtatgcattcagtaaacctggcggcagcgcaaaagatg

SEQ ID NO: 242917 - DNA, 103 bp, Artificial Sequence
  Synthetic Polynucleotide
taatacgactcactatagggggctctggtcaagcactccagctactgaataacagaggagaattcagatgctggagtgcaacctggcggcagcgcaaaagatg

SEQ ID NO: 242918 - DNA, 103 bp, Artificial Sequence
  Synthetic Polynucleotide
taatacgactcactatagggcgctgcattcggctctggtcaagcactccaaacagaggagatggagtatgtgaccagagaacctggcggcagcgcaaaagatg

SEQ ID NO: 242919 - DNA, 103 bp, Artificial Sequence
  Synthetic Polynucleotide
taatacgactcactatagggcatcttctcccgctgcattcggctctggtcaacagaggagagaccagatgcgaatgcagaacctggcggcagcgcaaaagatg

SEQ ID NO: 242920 - DNA, 103 bp, Artificial Sequence
  Synthetic Polynucleotide
taatacgactcactatagggccatgtaaaccatcttctcccgctgcattcaacagaggagagaatgcatggggagaagaaacctggcggcagcgcaaaagatg

SEQ ID NO: 242921 - DNA, 103 bp, Artificial Sequence
  Synthetic Polynucleotide
taatacgactcactatagggtctttaactgccatgtaaaccatcttctccaacagaggagaggagaaatgggtttacataacctggcggcagcgcaaaagatg

SEQ ID NO: 242922 - DNA, 103 bp, Artificial Sequence
  Synthetic Polynucleotide
taatacgactcactatagggttgagaagaatctttaactgccatgtaaacaacagaggagagtttacatggcagttaaaaacctggcggcagcgcaaaagatg

SEQ ID NO: 242923 - DNA, 103 bp, Artificial Sequence
  Synthetic Polynucleotide
taatacgactcactatagggcatcttcttcttgagaagaatctttaactgaacagaggagacagttaatgattcttctcaacctggcggcagcgcaaaagatg

SEQ ID NO: 242924 - DNA, 103 bp, Artificial Sequence
  Synthetic Polynucleotide
taatacgactcactatagggtcgatatgtgcagtaccagccattccagccaacagaggagaggctggatgggctggtacaacctggcggcagcgcaaaagatg

SEQ ID NO: 242925 - DNA, 103 bp, Artificial Sequence
  Synthetic Polynucleotide
taatacgactcactatagggtctctgatatcatcttcttcttgagaagaaaacagaggagattcttcatgagaagaagaaacctggcggcagcgcaaaagatg

SEQ ID NO: 242926 - DNA, 103 bp, Artificial Sequence
  Synthetic Polynucleotide
taatacgactcactatagggtcttctttcatctctgatatcatcttcttcaacagaggagagaagaaatggatatcagaaacctggcggcagcgcaaaagatg

SEQ ID NO: 242927 - DNA, 103 bp, Artificial Sequence
  Synthetic Polynucleotide
taatacgactcactatagggttcgggaaactcttctttcatctctgatataacagaggagaatatcaatgatgaaagaaaacctggcggcagcgcaaaagatg

SEQ ID NO: 242928 - DNA, 103 bp, Artificial Sequence
  Synthetic Polynucleotide
taatacgactcactatagggtcttcataccttcgggaaactcttctttcaaacagaggagatgaaagatgagtttcccgaacctggcggcagcgcaaaagatg

SEQ ID NO: 242929 - DNA, 103 bp, Artificial Sequence
  Synthetic Polynucleotide
taatacgactcactatagggtgcttgacaatcttcataccttcgggaaacaacagaggagagtttccatgaggtatgaaaacctggcggcagcgcaaaagatg

SEQ ID NO: 242930 - DNA, 103 bp, Artificial Sequence
  Synthetic Polynucleotide
taatacgactcactatagggtatttcctgatgcttgacaatcttcataccaacagaggagaggtatgatgattgtcaagaacctggcggcagcgcaaaagatg

SEQ ID NO: 242931 - DNA, 103 bp, Artificial Sequence
  Synthetic Polynucleotide
taatacgactcactataggggagtccaaagtatttcctgatgcttgacaaaacagaggagattgtcaatgatcaggaaaaacctggcggcagcgcaaaagatg

SEQ ID NO: 242932 - DNA, 103 bp, Artificial Sequence
  Synthetic Polynucleotide
taatacgactcactatagggttctaatgctgagtccaaagtatttcctgaaacagaggagatcaggaatgactttggacaacctggcggcagcgcaaaagatg

SEQ ID NO: 242933 - DNA, 103 bp, Artificial Sequence
  Synthetic Polynucleotide
taatacgactcactatagggtacttctgctttctaatgctgagtccaaagaacagaggagactttggatgcagcattagaacctggcggcagcgcaaaagatg

SEQ ID NO: 242934 - DNA, 103 bp, Artificial Sequence
  Synthetic Polynucleotide
taatacgactcactataggggctgctgtactacttctgctttctaatgctaacagaggagaagcattatgaagcagaagaacctggcggcagcgcaaaagatg

SEQ ID NO: 242935 - DNA, 103 bp, Artificial Sequence
  Synthetic Polynucleotide
taatacgactcactatagggttcacaagccaggagacttgcctgagccataacagaggagaatggctatggcaagtctcaacctggcggcagcgcaaaagatg

SEQ ID NO: 242936 - DNA, 103 bp, Artificial Sequence
  Synthetic Polynucleotide
taatacgactcactatagggctcgccattctcggcctgcttgctggcaataacagaggagaattgccatgaagcaggccaacctggcggcagcgcaaaagatg

SEQ ID NO: 242937 - DNA, 103 bp, Artificial Sequence
  Synthetic Polynucleotide
taatacgactcactatagggtacctgcccgctcgccattctcggcctgctaacagaggagaagcaggatgagaatggcgaacctggcggcagcgcaaaagatg

SEQ ID NO: 242938 - DNA, 103 bp, Artificial Sequence
  Synthetic Polynucleotide
taatacgactcactatagggacatcagggctacctgcccgctcgccattcaacagaggagagaatggatggcgggcaggaacctggcggcagcgcaaaagatg

SEQ ID NO: 242939 - DNA, 103 bp, Artificial Sequence
  Synthetic Polynucleotide
taatacgactcactataggggcacctcagcacatcagggctacctgcccgaacagaggagacgggcaatgagccctgataacctggcggcagcgcaaaagatg

SEQ ID NO: 242940 - DNA, 103 bp, Artificial Sequence
  Synthetic Polynucleotide
taatacgactcactatagggcctgactcgagcacctcagcacatcagggcaacagaggagagccctgatgtgctgaggtaacctggcggcagcgcaaaagatg

SEQ ID NO: 242941 - DNA, 103 bp, Artificial Sequence
  Synthetic Polynucleotide
taatacgactcactatagggtttcggtgaccctgactcgagcacctcagcaacagaggagagctgagatgctcgagtcaaacctggcggcagcgcaaaagatg

SEQ ID NO: 242942 - DNA, 103 bp, Artificial Sequence
  Synthetic Polynucleotide
taatacgactcactatagggatcactgtcttttcggtgaccctgactcgaaacagaggagatcgagtatgggtcaccgaaacctggcggcagcgcaaaagatg

SEQ ID NO: 242943 - DNA, 103 bp, Artificial Sequence
  Synthetic Polynucleotide
taatacgactcactatagggtccgggacttatcactgtcttttcggtgacaacagaggagagtcaccatgaagacagtgaacctggcggcagcgcaaaagatg

SEQ ID NO: 242944 - DNA, 103 bp, Artificial Sequence
  Synthetic Polynucleotide
taatacgactcactatagggtctttgcggctccgggacttatcactgtctaacagaggagaagacagatgtaagtcccgaacctggcggcagcgcaaaagatg

SEQ ID NO: 242945 - DNA, 103 bp, Artificial Sequence
  Synthetic Polynucleotide
taatacgactcactataggggctgtcatcatctttgcggctccgggacttaacagaggagaaagtccatgagccgcaaaaacctggcggcagcgcaaaagatg

SEQ ID NO: 242946 - DNA, 103 bp, Artificial Sequence
  Synthetic Polynucleotide
taatacgactcactatagggctgctaggccttcacaagccaggagacttgaacagaggagacaagtcatgtggcttgtgaacctggcggcagcgcaaaagatg

SEQ ID NO: 242947 - DNA, 103 bp, Artificial Sequence
  Synthetic Polynucleotide
taatacgactcactatagggcctcagacaagctgtcatcatctttgcggcaacagaggagagccgcaatgatgatgacaaacctggcggcagcgcaaaagatg

SEQ ID NO: 242948 - DNA, 103 bp, Artificial Sequence
  Synthetic Polynucleotide
taatacgactcactataggggaatgagaggcctcagacaagctgtcatcaaacagaggagatgatgaatgcttgtctgaaacctggcggcagcgcaaaagatg

SEQ ID NO: 242949 - DNA, 103 bp, Artificial Sequence
  Synthetic Polynucleotide
taatacgactcactatagggagtcttttttgaatgagaggcctcagacaaaacagaggagattgtctatggcctctcataacctggcggcagcgcaaaagatg

SEQ ID NO: 242950 - DNA, 103 bp, Artificial Sequence
  Synthetic Polynucleotide
taatacgactcactatagggcctttttaacagtcttttttgaatgagaggaacagaggagacctctcatgcaaaaaagaaacctggcggcagcgcaaaagatg

SEQ ID NO: 242951 - DNA, 103 bp, Artificial Sequence
  Synthetic Polynucleotide
taatacgactcactatagggactaccaccacctttttaacagtcttttttaacagaggagaaaaaaaatgtgttaaaaaaacctggcggcagcgcaaaagatg

SEQ ID NO: 242952 - DNA, 103 bp, Artificial Sequence
  Synthetic Polynucleotide
taatacgactcactatagggattttgttccactaccaccacctttttaacaacagaggagagttaaaatggtggtggtaaacctggcggcagcgcaaaagatg

SEQ ID NO: 242953 - DNA, 103 bp, Artificial Sequence
  Synthetic Polynucleotide
taatacgactcactataggggaaaagaaccattttgttccactaccaccaaacagaggagatggtggatgtggaacaaaaacctggcggcagcgcaaaagatg

SEQ ID NO: 242954 - DNA, 103 bp, Artificial Sequence
  Synthetic Polynucleotide
taatacgactcactatagggatctttacttgaaaagaaccattttgttccaacagaggagaggaacaatgtggttctttaacctggcggcagcgcaaaagatg

SEQ ID NO: 242955 - DNA, 103 bp, Artificial Sequence
  Synthetic Polynucleotide
taatacgactcactatagggatttttgggaatctttacttgaaaagaaccaacagaggagaggttctatgcaagtaaagaacctggcggcagcgcaaaagatg

SEQ ID NO: 242956 - DNA, 103 bp, Artificial Sequence
  Synthetic Polynucleotide
taatacgactcactatagggcacaaacaaaatttttgggaatctttacttaacagaggagaaagtaaatgttcccaaaaaacctggcggcagcgcaaaagatg

SEQ ID NO: 242957 - DNA, 103 bp, Artificial Sequence
  Synthetic Polynucleotide
taatacgactcactatagggaaactcacacctgctaggccttcacaagccaacagaggagaggcttgatgaggcctagcaacctggcggcagcgcaaaagatg

SEQ ID NO: 242958 - DNA, 103 bp, Artificial Sequence
  Synthetic Polynucleotide
taatacgactcactatagggaagcagtgttcacaaacaaaatttttgggaaacagaggagatcccaaatgttttgtttgaacctggcggcagcgcaaaagatg

SEQ ID NO: 242959 - DNA, 103 bp, Artificial Sequence
  Synthetic Polynucleotide
taatacgactcactatagggaaaggctccaaagcagtgttcacaaacaaaaacagaggagatttgttatggaacactgcaacctggcggcagcgcaaaagatg

SEQ ID NO: 242960 - DNA, 103 bp, Artificial Sequence
  Synthetic Polynucleotide
taatacgactcactatagggaactgctccgaaaggctccaaagcagtgttaacagaggagaaacactatgttggagcctaacctggcggcagcgcaaaagatg

SEQ ID NO: 242961 - DNA, 103 bp, Artificial Sequence
  Synthetic Polynucleotide
taatacgactcactatagggtttaggtggtaactgctccgaaaggctccaaacagaggagatggagcatgtcggagcagaacctggcggcagcgcaaaagatg

SEQ ID NO: 242962 - DNA, 103 bp, Artificial Sequence
  Synthetic Polynucleotide
taatacgactcactataggggatgtgcctctttaggtggtaactgctccgaacagaggagacggagcatgtaccacctaaacctggcggcagcgcaaaagatg

SEQ ID NO: 242963 - DNA, 103 bp, Artificial Sequence
  Synthetic Polynucleotide
taatacgactcactatagggtgtgaataaggatgtgcctctttaggtggtaacagaggagaaccaccatgagaggcacaaacctggcggcagcgcaaaagatg

SEQ ID NO: 242964 - DNA, 103 bp, Artificial Sequence
  Synthetic Polynucleotide
taatacgactcactatagggttctcaccagtgtgaataaggatgtgcctcaacagaggagagaggcaatgccttattcaaacctggcggcagcgcaaaagatg

SEQ ID NO: 242965 - DNA, 103 bp, Artificial Sequence
  Synthetic Polynucleotide
taatacgactcactatagggttcaaatggcttctcaccagtgtgaataagaacagaggagacttattatgactggtgagaacctggcggcagcgcaaaagatg

SEQ ID NO: 242966 - DNA, 103 bp, Artificial Sequence
  Synthetic Polynucleotide
taatacgactcactatagggatatatcgcattcaaatggcttctcaccagaacagaggagactggtgatgagccatttgaacctggcggcagcgcaaaagatg

SEQ ID NO: 242967 - DNA, 103 bp, Artificial Sequence
  Synthetic Polynucleotide
taatacgactcactatagggcgcatatcacatatatcgcattcaaatggcaacagaggagagccattatgatgcgatataacctggcggcagcgcaaaagatg

SEQ ID NO: 242968 - DNA, 103 bp, Artificial Sequence
  Synthetic Polynucleotide
taatacgactcactatagggagtgggaaccaaactcacacctgctaggccaacagaggagaggcctaatgggtgtgagtaacctggcggcagcgcaaaagatg

SEQ ID NO: 242969 - DNA, 103 bp, Artificial Sequence
  Synthetic Polynucleotide
taatacgactcactatagggctggatgaaacgcatatcacatatatcgcaaacagaggagatgcgatatgtgtgatatgaacctggcggcagcgcaaaagatg

SEQ ID NO: 242970 - DNA, 103 bp, Artificial Sequence
  Synthetic Polynucleotide
taatacgactcactatagggggtggtacttctggatgaaacgcatatcacaacagaggagagtgataatggtttcatccaacctggcggcagcgcaaaagatg

SEQ ID NO: 242971 - DNA, 103 bp, Artificial Sequence
  Synthetic Polynucleotide
taatacgactcactatagggtggcgttccaggtggtacttctggatgaaaaacagaggagatttcatatggaagtaccaaacctggcggcagcgcaaaagatg

SEQ ID NO: 242972 - DNA, 103 bp, Artificial Sequence
  Synthetic Polynucleotide
taatacgactcactatagggcacacgcttgtggcgttccaggtggtacttaacagaggagaaagtacatgctggaacgcaacctggcggcagcgcaaaagatg

SEQ ID NO: 242973 - DNA, 103 bp, Artificial Sequence
  Synthetic Polynucleotide
taatacgactcactatagggcaccactgtgcacacgcttgtggcgttccaaacagaggagatggaacatgacaagcgtgaacctggcggcagcgcaaaagatg

SEQ ID NO: 242974 - DNA, 103 bp, Artificial Sequence
  Synthetic Polynucleotide
taatacgactcactatagggtaaggcttttcaccactgtgcacacgcttgaacagaggagacaagcgatggcacagtggaacctggcggcagcgcaaaagatg

SEQ ID NO: 242975 - DNA, 103 bp, Artificial Sequence
  Synthetic Polynucleotide
taatacgactcactatagggttcacactggtaaggcttttcaccactgtgaacagaggagacacagtatggaaaagcctaacctggcggcagcgcaaaagatg

SEQ ID NO: 242976 - DNA, 103 bp, Artificial Sequence
  Synthetic Polynucleotide
taatacgactcactataggggatgacaccgttcacactggtaaggcttttaacagaggagaaaaagcatgaccagtgtgaacctggcggcagcgcaaaagatg

SEQ ID NO: 242977 - DNA, 103 bp, Artificial Sequence
  Synthetic Polynucleotide
taatacgactcactataggggaaaaacactgatgacaccgttcacactggaacagaggagaccagtgatgacggtgtcaaacctggcggcagcgcaaaagatg

SEQ ID NO: 242978 - DNA, 103 bp, Artificial Sequence
  Synthetic Polynucleotide
taatacgactcactatagggatctgtccgagaaaaacactgatgacaccgaacagaggagacggtgtatgcagtgttttaacctggcggcagcgcaaaagatg

SEQ ID NO: 242979 - DNA, 103 bp, Artificial Sequence
  Synthetic Polynucleotide
taatacgactcactatagggtgctggctgcagtgggaaccaaactcacacaacagaggagagtgtgaatgtggttcccaaacctggcggcagcgcaaaagatg

SEQ ID NO: 242980 - DNA, 103 bp, Artificial Sequence
  Synthetic Polynucleotide
taatacgactcactatagggtgagtaatcgatctgtccgagaaaaacactaacagaggagaagtgttatgctcggacagaacctggcggcagcgcaaaagatg

SEQ ID NO: 242981 - DNA, 103 bp, Artificial Sequence
  Synthetic Polynucleotide
taatacgactcactatagggcgtttgtgtctgagtaatcgatctgtccgaaacagaggagatcggacatgtcgattactaacctggcggcagcgcaaaagatg

SEQ ID NO: 242982 - DNA, 103 bp, Artificial Sequence
  Synthetic Polynucleotide
taatacgactcactatagggttggcacatccgtttgtgtctgagtaatcgaacagaggagacgattaatgagacacaaaaacctggcggcagcgcaaaagatg

SEQ ID NO: 242983 - DNA, 103 bp, Artificial Sequence
  Synthetic Polynucleotide
taatacgactcactatagggactggcacccttggcacatccgtttgtgtcaacagaggagagacacaatgggatgtgccaacctggcggcagcgcaaaagatg

SEQ ID NO: 242984 - DNA, 103 bp, Artificial Sequence
  Synthetic Polynucleotide
taatacgactcactataggggaagtcttggactggcacccttggcacatcaacagaggagagatgtgatgagggtgccaaacctggcggcagcgcaaaagatg

SEQ ID NO: 242985 - DNA, 103 bp, Artificial Sequence
  Synthetic Polynucleotide
taatacgactcactatagggctgcccgtcggaagtcttggactggcacccaacagaggagagggtgcatgtccaagactaacctggcggcagcgcaaaagatg

SEQ ID NO: 242986 - DNA, 103 bp, Artificial Sequence
  Synthetic Polynucleotide
taatacgactcactatagggatagagaaaactgcccgtcggaagtcttggaacagaggagaccaagaatgccgacgggcaacctggcggcagcgcaaaagatg

SEQ ID NO: 242987 - DNA, 103 bp, Artificial Sequence
  Synthetic Polynucleotide
taatacgactcactatagggatcatcttcttgctggctgcagtgggaaccaacagaggagaggttccatgtgcagccagaacctggcggcagcgcaaaagatg

SEQ ID NO: 242988 - DNA, 103 bp, Artificial Sequence
  Synthetic Polynucleotide
taatacgactcactatagggctggctcagcatcatcttcttgctggctgcaacagaggagagcagccatgaagaagatgaacctggcggcagcgcaaaagatg

SEQ ID NO: 242989 - DNA, 103 bp, Artificial Sequence
  Synthetic Polynucleotide
taatacgactcactatagggtgctggcaatctggctcagcatcatcttctaacagaggagaagaagaatgtgctgagccaacctggcggcagcgcaaaagatg

SEQ ID NO: 242990 - DNA, 103 bp, Artificial Sequence
  Synthetic Polynucleotide
taatacgactcactatagggtcggcctgcttgctggcaatctggctcagcaacagaggagagctgagatggattgccagaacctggcggcagcgcaaaagatg

SEQ ID NO: 242991 - DNA, 103 bp, Artificial Sequence
  Synthetic Polynucleotide
taatacgactcactatagggagaaatcggagccgcgaccgcctcggccataacagaggagaatggccatggcggtcgcgaacctggcggcagcgcaaaagatg

SEQ ID NO: 242992 - DNA, 103 bp, Artificial Sequence
  Synthetic Polynucleotide
taatacgactcactatagggcccggttcgaccttctagggaaagcaggcgaacagaggagacgcctgatgtccctagaaaacctggcggcagcgcaaaagatg

SEQ ID NO: 242993 - DNA, 103 bp, Artificial Sequence
  Synthetic Polynucleotide
taatacgactcactataggggtcctggctggggaaggagctgccctggctaacagaggagaagccagatgagctccttcaacctggcggcagcgcaaaagatg

SEQ ID NO: 242994 - DNA, 103 bp, Artificial Sequence
  Synthetic Polynucleotide
taatacgactcactatagggccagcacagggtcctggctggggaaggagcaacagaggagagctcctatgccagccaggaacctggcggcagcgcaaaagatg

SEQ ID NO: 242995 - DNA, 103 bp, Artificial Sequence
  Synthetic Polynucleotide
taatacgactcactatagggtctcgcagccccagcacagggtcctggctgaacagaggagacagccaatgccctgtgctaacctggcggcagcgcaaaagatg

SEQ ID NO: 242996 - DNA, 103 bp, Artificial Sequence
  Synthetic Polynucleotide
taatacgactcactatagggccgggcgggctctcgcagccccagcacaggaacagaggagacctgtgatggggctgcgaaacctggcggcagcgcaaaagatg

SEQ ID NO: 242997 - DNA, 103 bp, Artificial Sequence
  Synthetic Polynucleotide
taatacgactcactatagggccctctcaggccgggcgggctctcgcagccaacagaggagaggctgcatgagcccgcccaacctggcggcagcgcaaaagatg

SEQ ID NO: 242998 - DNA, 103 bp, Artificial Sequence
  Synthetic Polynucleotide
taatacgactcactatagggtcacccatgtccctctcaggccgggcgggcaacagaggagagcccgcatggcctgagagaacctggcggcagcgcaaaagatg

SEQ ID NO: 242999 - DNA, 103 bp, Artificial Sequence
  Synthetic Polynucleotide
taatacgactcactatagggaggactgagctcacccatgtccctctcaggaacagaggagacctgagatggacatgggtaacctggcggcagcgcaaaagatg

SEQ ID NO: 243000 - DNA, 103 bp, Artificial Sequence
  Synthetic Polynucleotide
taatacgactcactataggggggccacagcaggactgagctcacccatgtaacagaggagaacatggatgagctcagtcaacctggcggcagcgcaaaagatg

SEQ ID NO: 243001 - DNA, 103 bp, Artificial Sequence
  Synthetic Polynucleotide
taatacgactcactataggggtctcctcctgggccacagcaggactgagcaacagaggagagctcagatgtgctgtggcaacctggcggcagcgcaaaagatg

SEQ ID NO: 243002 - DNA, 103 bp, Artificial Sequence
  Synthetic Polynucleotide
taatacgactcactatagggcccaggaggggtctcctcctgggccacagcaacagaggagagctgtgatgcaggaggagaacctggcggcagcgcaaaagatg

SEQ ID NO: 243003 - DNA, 103 bp, Artificial Sequence
  Synthetic Polynucleotide
taatacgactcactatagggtctcggccatcccggttcgaccttctagggaacagaggagaccctagatggtcgaaccgaacctggcggcagcgcaaaagatg

SEQ ID NO: 243004 - DNA, 103 bp, Artificial Sequence
  Synthetic Polynucleotide
taatacgactcactatagggagagccagtccccaggaggggtctcctcctaacagaggagaaggaggatgcccctcctgaacctggcggcagcgcaaaagatg

SEQ ID NO: 243005 - DNA, 103 bp, Artificial Sequence
  Synthetic Polynucleotide
taatacgactcactatagggacccctccgaagagccagtccccaggagggaacagaggagaccctccatgggactggctaacctggcggcagcgcaaaagatg

SEQ ID NO: 243006 - DNA, 103 bp, Artificial Sequence
  Synthetic Polynucleotide
taatacgactcactataggggccccaccggacccctccgaagagccagtcaacagaggagagactggatgttcggagggaacctggcggcagcgcaaaagatg

SEQ ID NO: 243007 - DNA, 103 bp, Artificial Sequence
  Synthetic Polynucleotide
taatacgactcactatagggggaaattccagccccaccggacccctccgaaacagaggagatcggagatgtccggtgggaacctggcggcagcgcaaaagatg

SEQ ID NO: 243008 - DNA, 103 bp, Artificial Sequence
  Synthetic Polynucleotide
taatacgactcactatagggggtttacaccggaaattccagccccaccggaacagaggagaccggtgatgctggaatttaacctggcggcagcgcaaaagatg

SEQ ID NO: 243009 - DNA, 103 bp, Artificial Sequence
  Synthetic Polynucleotide
taatacgactcactataggggcccactggcggtttacaccggaaattccaaacagaggagatggaatatgcggtgtaaaaacctggcggcagcgcaaaagatg

SEQ ID NO: 243010 - DNA, 103 bp, Artificial Sequence
  Synthetic Polynucleotide
taatacgactcactatagggtcgggttcaggcccactggcggtttacaccaacagaggagaggtgtaatgcgccagtggaacctggcggcagcgcaaaagatg

SEQ ID NO: 243011 - DNA, 103 bp, Artificial Sequence
  Synthetic Polynucleotide
taatacgactcactatagggggccccgtcctcgggttcaggcccactggcaacagaggagagccagtatgcctgaacccaacctggcggcagcgcaaaagatg

SEQ ID NO: 243012 - DNA, 103 bp, Artificial Sequence
  Synthetic Polynucleotide
taatacgactcactatagggaagcccctcgggccccgtcctcgggttcagaacagaggagactgaacatgaggacggggaacctggcggcagcgcaaaagatg

SEQ ID NO: 243013 - DNA, 103 bp, Artificial Sequence
  Synthetic Polynucleotide
taatacgactcactatagggaggagtaaggaagcccctcgggccccgtccaacagaggagaggacggatgccgaggggcaacctggcggcagcgcaaaagatg

SEQ ID NO: 243014 - DNA, 103 bp, Artificial Sequence
  Synthetic Polynucleotide
taatacgactcactataggggccagcttcttctcggccatcccggttcgaaacagaggagatcgaacatggatggccgaaacctggcggcagcgcaaaagatg

SEQ ID NO: 243015 - DNA, 103 bp, Artificial Sequence
  Synthetic Polynucleotide
taatacgactcactatagggttgtccggggaggagtaaggaagcccctcgaacagaggagacgagggatgtccttactcaacctggcggcagcgcaaaagatg

SEQ ID NO: 243016 - DNA, 103 bp, Artificial Sequence
  Synthetic Polynucleotide
taatacgactcactatagggggcctctccgttgtccggggaggagtaaggaacagaggagaccttacatgtccccggacaacctggcggcagcgcaaaagatg

SEQ ID NO: 243017 - DNA, 103 bp, Artificial Sequence
  Synthetic Polynucleotide
taatacgactcactatagggggtccaagatggcctctccgttgtccggggaacagaggagaccccggatgacggagaggaacctggcggcagcgcaaaagatg

SEQ ID NO: 243018 - DNA, 103 bp, Artificial Sequence
  Synthetic Polynucleotide
taatacgactcactataggggcctggctggggtccaagatggcctctccgaacagaggagacggagaatgcatcttggaaacctggcggcagcgcaaaagatg

SEQ ID NO: 243019 - DNA, 103 bp, Artificial Sequence
  Synthetic Polynucleotide
taatacgactcactatagggtggccttggggcctggctggggtccaagataacagaggagaatcttgatgcccagccagaacctggcggcagcgcaaaagatg

SEQ ID NO: 243020 - DNA, 103 bp, Artificial Sequence
  Synthetic Polynucleotide
taatacgactcactataggggttcgttgaatggccttggggcctggctggaacagaggagaccagccatgccccaaggcaacctggcggcagcgcaaaagatg

SEQ ID NO: 243021 - DNA, 103 bp, Artificial Sequence
  Synthetic Polynucleotide
taatacgactcactatagggtatttacagggttcgttgaatggccttgggaacagaggagacccaagatgattcaacgaaacctggcggcagcgcaaaagatg

SEQ ID NO: 243022 - DNA, 103 bp, Artificial Sequence
  Synthetic Polynucleotide
taatacgactcactatagggccggccagggtatttacagggttcgttgaaaacagaggagattcaacatgccctgtaaaaacctggcggcagcgcaaaagatg

SEQ ID NO: 243023 - DNA, 103 bp, Artificial Sequence
  Synthetic Polynucleotide
taatacgactcactatagggagcctttggtccggccagggtatttacaggaacagaggagacctgtaatgaccctggccaacctggcggcagcgcaaaagatg

SEQ ID NO: 243024 - DNA, 103 bp, Artificial Sequence
  Synthetic Polynucleotide
taatacgactcactatagggttgtggccaaagcctttggtccggccagggaacagaggagaccctggatggaccaaaggaacctggcggcagcgcaaaagatg

SEQ ID NO: 243025 - DNA, 103 bp, Artificial Sequence
  Synthetic Polynucleotide
taatacgactcactatagggctcgcaatcagccagcttcttctcggccataacagaggagaatggccatgaagaagctgaacctggcggcagcgcaaaagatg

SEQ ID NO: 243026 - DNA, 103 bp, Artificial Sequence
  Synthetic Polynucleotide
taatacgactcactatagggcagccctggcttgtggccaaagcctttggtaacagaggagaaccaaaatgtttggccacaacctggcggcagcgcaaaagatg

SEQ ID NO: 243027 - DNA, 103 bp, Artificial Sequence
  Synthetic Polynucleotide
taatacgactcactatagggggtgcttcttcagccctggcttgtggccaaaacagaggagattggccatgagccagggcaacctggcggcagcgcaaaagatg

SEQ ID NO: 243028 - DNA, 103 bp, Artificial Sequence
  Synthetic Polynucleotide
taatacgactcactatagggggcgccgcggggtgcttcttcagccctggcaacagaggagagccaggatggaagaagcaaacctggcggcagcgcaaaagatg

SEQ ID NO: 243029 - DNA, 103 bp, Artificial Sequence
  Synthetic Polynucleotide
taatacgactcactataggggcccccggggggcgccgcggggtgcttcttaacagaggagaaagaagatgcccgcggcgaacctggcggcagcgcaaaagatg

SEQ ID NO: 243030 - DNA, 103 bp, Artificial Sequence
  Synthetic Polynucleotide
taatacgactcactatagggtgaagggccggcccccggggggcgccgcggaacagaggagaccgcggatgcccccggggaacctggcggcagcgcaaaagatg

SEQ ID NO: 243031 - DNA, 103 bp, Artificial Sequence
  Synthetic Polynucleotide
taatacgactcactataggggtggcgcaggtgaagggccggcccccggggaacagaggagaccccggatgccggcccttaacctggcggcagcgcaaaagatg

SEQ ID NO: 243032 - DNA, 103 bp, Artificial Sequence
  Synthetic Polynucleotide
taatacgactcactatagggcttcccacacgtggcgcaggtgaagggccgaacagaggagacggcccatgacctgcgccaacctggcggcagcgcaaaagatg

SEQ ID NO: 243033 - DNA, 103 bp, Artificial Sequence
  Synthetic Polynucleotide
taatacgactcactataggggctggaagctcttcccacacgtggcgcaggaacagaggagacctgcgatgcgtgtgggaaacctggcggcagcgcaaaagatg

SEQ ID NO: 243034 - DNA, 103 bp, Artificial Sequence
  Synthetic Polynucleotide
taatacgactcactatagggctgacttgcagctggaagctcttcccacacaacagaggagagtgtggatggagcttccaaacctggcggcagcgcaaaagatg

SEQ ID NO: 243035 - DNA, 103 bp, Artificial Sequence
  Synthetic Polynucleotide
taatacgactcactatagggcgcgctcaggctgacttgcagctggaagctaacagaggagaagcttcatgctgcaagtcaacctggcggcagcgcaaaagatg

SEQ ID NO: 243036 - DNA, 103 bp, Artificial Sequence
  Synthetic Polynucleotide
taatacgactcactatagggcggctgtcttctcgcaatcagccagcttctaacagaggagaagaagcatgctgattgcgaacctggcggcagcgcaaaagatg

SEQ ID NO: 243037 - DNA, 103 bp, Artificial Sequence
  Synthetic Polynucleotide
taatacgactcactatagggtgcgctggtgcgcgctcaggctgacttgcaaacagaggagatgcaagatggcctgagcgaacctggcggcagcgcaaaagatg

SEQ ID NO: 243038 - DNA, 103 bp, Artificial Sequence
  Synthetic Polynucleotide
taatacgactcactataggggccccacagctgcgctggtgcgcgctcaggaacagaggagacctgagatggcaccagcgaacctggcggcagcgcaaaagatg

SEQ ID NO: 243039 - DNA, 103 bp, Artificial Sequence
  Synthetic Polynucleotide
taatacgactcactatagggcccgtcgggcgccccacagctgcgctggtgaacagaggagacaccagatgagctgtgggaacctggcggcagcgcaaaagatg

SEQ ID NO: 243040 - DNA, 103 bp, Artificial Sequence
  Synthetic Polynucleotide
taatacgactcactatagggccgggcccgacccgtcgggcgccccacagcaacagaggagagctgtgatgcgcccgacgaacctggcggcagcgcaaaagatg

SEQ ID NO: 243041 - DNA, 103 bp, Artificial Sequence
  Synthetic Polynucleotide
taatacgactcactatagggccgcctgtgcccgggcccgacccgtcgggcaacagaggagagcccgaatggtcgggcccaacctggcggcagcgcaaaagatg

SEQ ID NO: 243042 - DNA, 103 bp, Artificial Sequence
  Synthetic Polynucleotide
taatacgactcactataggggctgccgccaccgcctgtgcccgggcccgaaacagaggagatcgggcatgggcacaggcaacctggcggcagcgcaaaagatg

SEQ ID NO: 243043 - DNA, 103 bp, Artificial Sequence
  Synthetic Polynucleotide
taatacgactcactatagggcgccactgccgctgccgccaccgcctgtgcaacagaggagagcacagatggtggcggcaaacctggcggcagcgcaaaagatg

SEQ ID NO: 243044 - DNA, 103 bp, Artificial Sequence
  Synthetic Polynucleotide
taatacgactcactatagggccaccgccgccgccactgccgctgccgccaaacagaggagatggcggatgcggcagtggaacctggcggcagcgcaaaagatg

SEQ ID NO: 243045 - DNA, 103 bp, Artificial Sequence
  Synthetic Polynucleotide
taatacgactcactatagggaccgctgccgccaccgccgccgccactgccaacagaggagaggcagtatgggcggcggtaacctggcggcagcgcaaaagatg

SEQ ID NO: 243046 - DNA, 103 bp, Artificial Sequence
  Synthetic Polynucleotide
taatacgactcactatagggcgctgcccccaccgctgccgccaccgccgcaacagaggagagcggcgatggcggcagcgaacctggcggcagcgcaaaagatg

SEQ ID NO: 243047 - DNA, 103 bp, Artificial Sequence
  Synthetic Polynucleotide
taatacgactcactatagggccgaactccacggctgtcttctcgcaatcaaacagaggagatgattgatggaagacagcaacctggcggcagcgcaaaagatg

SEQ ID NO: 243048 - DNA, 103 bp, Artificial Sequence
  Synthetic Polynucleotide
taatacgactcactatagggccatcccgtgcgctgcccccaccgctgccgaacagaggagacggcagatgtgggggcagaacctggcggcagcgcaaaagatg

SEQ ID NO: 243049 - DNA, 103 bp, Artificial Sequence
  Synthetic Polynucleotide
taatacgactcactatagggaagggcgctgccatcccgtgcgctgcccccaacagaggagagggggcatggcacgggataacctggcggcagcgcaaaagatg

SEQ ID NO: 243050 - DNA, 103 bp, Artificial Sequence
  Synthetic Polynucleotide
taatacgactcactatagggccccacaccgaagggcgctgccatcccgtgaacagaggagacacgggatggcagcgcccaacctggcggcagcgcaaaagatg

SEQ ID NO: 243051 - DNA, 103 bp, Artificial Sequence
  Synthetic Polynucleotide
taatacgactcactatagggcggccgcactccccacaccgaagggcgctgaacagaggagacagcgcatgtcggtgtggaacctggcggcagcgcaaaagatg

SEQ ID NO: 243052 - DNA, 103 bp, Artificial Sequence
  Synthetic Polynucleotide
taatacgactcactatagggcgtgaagcaacggccgcactccccacaccgaacagaggagacggtgtatggagtgcggcaacctggcggcagcgcaaaagatg

SEQ ID NO: 243053 - DNA, 103 bp, Artificial Sequence
  Synthetic Polynucleotide
taatacgactcactataggggcgcggggcgcgtgaagcaacggccgcactaacagaggagaagtgcgatggttgcttcaaacctggcggcagcgcaaaagatg

SEQ ID NO: 243054 - DNA, 103 bp, Artificial Sequence
  Synthetic Polynucleotide
taatacgactcactatagggcggatgaggtgcgcggggcgcgtgaagcaaaacagaggagattgcttatggcgccccgcaacctggcggcagcgcaaaagatg

SEQ ID NO: 243055 - DNA, 103 bp, Artificial Sequence
  Synthetic Polynucleotide
taatacgactcactatagggcatgcgatggcggatgaggtgcgcggggcgaacagaggagacgccccatgcacctcatcaacctggcggcagcgcaaaagatg

SEQ ID NO: 243056 - DNA, 103 bp, Artificial Sequence
  Synthetic Polynucleotide
taatacgactcactatagggcggtgtgcagcatgcgatggcggatgaggtaacagaggagaacctcaatggccatcgcaaacctggcggcagcgcaaaagatg

SEQ ID NO: 243057 - DNA, 103 bp, Artificial Sequence
  Synthetic Polynucleotide
taatacgactcactatagggggccgctcgccggtgtgcagcatgcgatggaacagaggagaccatcgatggctgcacacaacctggcggcagcgcaaaagatg

SEQ ID NO: 243058 - DNA, 103 bp, Artificial Sequence
  Synthetic Polynucleotide
taatacgactcactatagggcagctggttcccgaactccacggctgtcttaacagaggagaaagacaatggtggagttcaacctggcggcagcgcaaaagatg

SEQ ID NO: 243059 - DNA, 103 bp, Artificial Sequence
  Synthetic Polynucleotide
taatacgactcactataggggcaggggaagggccgctcgccggtgtgcagaacagaggagactgcacatgggcgagcggaacctggcggcagcgcaaaagatg

SEQ ID NO: 243060 - DNA, 103 bp, Artificial Sequence
  Synthetic Polynucleotide
taatacgactcactatagggcacactcggtgcaggggaagggccgctcgcaacagaggagagcgagcatgccttcccctaacctggcggcagcgcaaaagatg

SEQ ID NO: 243061 - DNA, 103 bp, Artificial Sequence
  Synthetic Polynucleotide
taatacgactcactatagggaagcgcttctcacactcggtgcaggggaagaacagaggagacttcccatgcaccgagtgaacctggcggcagcgcaaaagatg

SEQ ID NO: 243062 - DNA, 103 bp, Artificial Sequence
  Synthetic Polynucleotide
taatacgactcactataggggcgttcggtgaagcgcttctcacactcggtaacagaggagaaccgagatggagaagcgcaacctggcggcagcgcaaaagatg

SEQ ID NO: 243063 - DNA, 103 bp, Artificial Sequence
  Synthetic Polynucleotide
taatacgactcactatagggtgagcttggagcgttcggtgaagcgcttctaacagaggagaagaagcatgtcaccgaacaacctggcggcagcgcaaaagatg

SEQ ID NO: 243064 - DNA, 103 bp, Artificial Sequence
  Synthetic Polynucleotide
taatacgactcactatagggtagtggtcgatgagcttggagcgttcggtgaacagaggagacaccgaatgctccaagctaacctggcggcagcgcaaaagatg

SEQ ID NO: 243065 - DNA, 103 bp, Artificial Sequence
  Synthetic Polynucleotide
taatacgactcactataggggtgcgttcggtagtggtcgatgagcttggaaacagaggagatccaagatgatcgaccacaacctggcggcagcgcaaaagatg

SEQ ID NO: 243066 - DNA, 103 bp, Artificial Sequence
  Synthetic Polynucleotide
taatacgactcactataggggcacgcccgtgtgcgttcggtagtggtcgaaacagaggagatcgaccatgaccgaacgcaacctggcggcagcgcaaaagatg

SEQ ID NO: 243067 - DNA, 103 bp, Artificial Sequence
  Synthetic Polynucleotide
taatacgactcactataggggtgaagggccgcacgcccgtgtgcgttcggaacagaggagaccgaacatgcacgggcgtaacctggcggcagcgcaaaagatg

SEQ ID NO: 243068 - DNA, 103 bp, Artificial Sequence
  Synthetic Polynucleotide
taatacgactcactataggggacggtgcaggtgaagggccgcacgcccgtaacagaggagaacgggcatgcggcccttcaacctggcggcagcgcaaaagatg

SEQ ID NO: 243069 - DNA, 103 bp, Artificial Sequence
  Synthetic Polynucleotide
taatacgactcactatagggacttgccctccagctggttcccgaactccaaacagaggagatggagtatgggaaccagcaacctggcggcagcgcaaaagatg

SEQ ID NO: 243070 - DNA, 103 bp, Artificial Sequence
  Synthetic Polynucleotide
taatacgactcactatagggttttgccgcagacggtgcaggtgaagggccaacagaggagaggccctatgcctgcaccgaacctggcggcagcgcaaaagatg

SEQ ID NO: 243071 - DNA, 103 bp, Artificial Sequence
  Synthetic Polynucleotide
taatacgactcactatagggcggatgaagcttttgccgcagacggtgcagaacagaggagactgcacatgctgcggcaaaacctggcggcagcgcaaaagatg

SEQ ID NO: 243072 - DNA, 103 bp, Artificial Sequence
  Synthetic Polynucleotide
taatacgactcactataggggtggtccttgcggatgaagcttttgccgcaaacagaggagatgcggcatgagcttcatcaacctggcggcagcgcaaaagatg

SEQ ID NO: 243073 - DNA, 103 bp, Artificial Sequence
  Synthetic Polynucleotide
taatacgactcactataggggcttgcggaggtggtccttgcggatgaagcaacagaggagagcttcaatggcaaggaccaacctggcggcagcgcaaaagatg

SEQ ID NO: 243074 - DNA, 103 bp, Artificial Sequence
  Synthetic Polynucleotide
taatacgactcactatagggttgcgctggtgcttgcggaggtggtccttgaacagaggagacaaggaatgcctccgcaaaacctggcggcagcgcaaaagatg

SEQ ID NO: 243075 - DNA, 103 bp, Artificial Sequence
  Synthetic Polynucleotide
taatacgactcactatagggcgctgcatggttgcgctggtgcttgcggagaacagaggagactccgcatgcaccagcgcaacctggcggcagcgcaaaagatg

SEQ ID NO: 243076 - DNA, 103 bp, Artificial Sequence
  Synthetic Polynucleotide
taatacgactcactatagggtcttggcgcccgctgcatggttgcgctggtaacagaggagaaccagcatgaccatgcagaacctggcggcagcgcaaaagatg

SEQ ID NO: 243077 - DNA, 103 bp, Artificial Sequence
  Synthetic Polynucleotide
taatacgactcactatagggcgggccggggtcttggcgcccgctgcatggaacagaggagaccatgcatggggcgccaaaacctggcggcagcgcaaaagatg

SEQ ID NO: 243078 - DNA, 103 bp, Artificial Sequence
  Synthetic Polynucleotide
taatacgactcactatagggtggctggcctcgggccggggtcttggcgccaacagaggagaggcgccatgaccccggccaacctggcggcagcgcaaaagatg

SEQ ID NO: 243079 - DNA, 103 bp, Artificial Sequence
  Synthetic Polynucleotide
taatacgactcactataggggcgtcgggagtggctggcctcgggccggggaacagaggagaccccggatggaggccagcaacctggcggcagcgcaaaagatg

SEQ ID NO: 243080 - DNA, 103 bp, Artificial Sequence
  Synthetic Polynucleotide
taatacgactcactatagggagcacggcccacttgccctccagctggttcaacagaggagagaaccaatgggagggcaaaacctggcggcagcgcaaaagatg

SEQ ID NO: 243081 - DNA, 103 bp, Artificial Sequence
  Synthetic Polynucleotide
taatacgactcactatagggggtgcgggcggcgtcgggagtggctggcctaacagaggagaaggccaatgactcccgacaacctggcggcagcgcaaaagatg

SEQ ID NO: 243082 - DNA, 103 bp, Artificial Sequence
  Synthetic Polynucleotide
taatacgactcactataggggggatcaggaggtgcgggcggcgtcgggagaacagaggagactcccgatgccgcccgcaaacctggcggcagcgcaaaagatg

SEQ ID NO: 243083 - DNA, 103 bp, Artificial Sequence
  Synthetic Polynucleotide
taatacgactcactatagggggctcttgaagggatcaggaggtgcgggcgaacagaggagacgcccgatgctcctgatcaacctggcggcagcgcaaaagatg

SEQ ID NO: 243084 - DNA, 103 bp, Artificial Sequence
  Synthetic Polynucleotide
taatacgactcactatagggttggaggcggggctcttgaagggatcaggaaacagaggagatcctgaatgcttcaagagaacctggcggcagcgcaaaagatg

SEQ ID NO: 243085 - DNA, 103 bp, Artificial Sequence
  Synthetic Polynucleotide
taatacgactcactatagggcaaaggtcctttggaggcggggctcttgaaaacagaggagattcaagatgcccgcctccaacctggcggcagcgcaaaagatg

SEQ ID NO: 243086 - DNA, 103 bp, Artificial Sequence
  Synthetic Polynucleotide
taatacgactcactatagggctgtggaggccaaaggtcctttggaggcggaacagaggagaccgcctatgaaggaccttaacctggcggcagcgcaaaagatg

SEQ ID NO: 243087 - DNA, 103 bp, Artificial Sequence
  Synthetic Polynucleotide
taatacgactcactataggggtcacaaggtctgtggaggccaaaggtcctaacagaggagaaggaccatgggcctccacaacctggcggcagcgcaaaagatg

SEQ ID NO: 243088 - DNA, 103 bp, Artificial Sequence
  Synthetic Polynucleotide
taatacgactcactatagggagtccagtcggtcacaaggtctgtggaggcaacagaggagagcctccatggaccttgtgaacctggcggcagcgcaaaagatg

SEQ ID NO: 243089 - DNA, 103 bp, Artificial Sequence
  Synthetic Polynucleotide
taatacgactcactatagggtgaggccacaagtccagtcggtcacaaggtaacagaggagaaccttgatgccgactggaaacctggcggcagcgcaaaagatg

SEQ ID NO: 243090 - DNA, 103 bp, Artificial Sequence
  Synthetic Polynucleotide
taatacgactcactatagggcccaggacgctgaggccacaagtccagtcgaacagaggagacgactgatgttgtggcctaacctggcggcagcgcaaaagatg

SEQ ID NO: 243091 - DNA, 103 bp, Artificial Sequence
  Synthetic Polynucleotide
taatacgactcactatagggcagggtccccagcacggcccacttgccctcaacagaggagagagggcatgtgggccgtgaacctggcggcagcgcaaaagatg

SEQ ID NO: 243092 - DNA, 103 bp, Artificial Sequence
  Synthetic Polynucleotide
taatacgactcactatagggatcggtgggtcccaggacgctgaggccacaaacagaggagatgtggcatgagcgtcctgaacctggcggcagcgcaaaagatg

SEQ ID NO: 243093 - DNA, 103 bp, Artificial Sequence
  Synthetic Polynucleotide
taatacgactcactatagggtgtccccgccatcggtgggtcccaggacgcaacagaggagagcgtccatggacccaccgaacctggcggcagcgcaaaagatg

SEQ ID NO: 243094 - DNA, 103 bp, Artificial Sequence
  Synthetic Polynucleotide
taatacgactcactatagggtcgtccacggagaaatcggagccgcgaccgaacagaggagacggtcgatgctccgatttaacctggcggcagcgcaaaagatg

SEQ ID NO: 243095 - DNA, 103 bp, Artificial Sequence
  Synthetic Polynucleotide
taatacgactcactatagggactcctgcagcagggtccccagcacggcccaacagaggagagggccgatgtggggacccaacctggcggcagcgcaaaagatg

SEQ ID NO: 243096 - DNA, 103 bp, Artificial Sequence
  Synthetic Polynucleotide
taatacgactcactatagggagcagcccgtactcctgcagcagggtccccaacagaggagaggggacatggctgcaggaaacctggcggcagcgcaaaagatg

SEQ ID NO: 243097 - DNA, 103 bp, Artificial Sequence
  Synthetic Polynucleotide
taatacgactcactatagggccgcctctgcagcagcccgtactcctgcagaacagaggagactgcagatgtacgggctgaacctggcggcagcgcaaaagatg

SEQ ID NO: 243098 - DNA, 103 bp, Artificial Sequence
  Synthetic Polynucleotide
taatacgactcactatagggcgttctccagccgcctctgcagcagcccgtaacagaggagaacgggcatgtgcagaggcaacctggcggcagcgcaaaagatg

SEQ ID NO: 243099 - DNA, 103 bp, Artificial Sequence
  Synthetic Polynucleotide
taatacgactcactatagggaggttctccacgttctccagccgcctctgcaacagaggagagcagagatggctggagaaaacctggcggcagcgcaaaagatg

SEQ ID NO: 243100 - DNA, 103 bp, Artificial Sequence
  Synthetic Polynucleotide
taatacgactcactataggggttgcgcagcaggttctccacgttctccagaacagaggagactggagatggtggagaacaacctggcggcagcgcaaaagatg

SEQ ID NO: 243101 - DNA, 103 bp, Artificial Sequence
  Synthetic Polynucleotide
taatacgactcactatagggagaagttcctgttgcgcagcaggttctccaaacagaggagatggagaatgtgctgcgcaaacctggcggcagcgcaaaagatg

SEQ ID NO: 243102 - DNA, 103 bp, Artificial Sequence
  Synthetic Polynucleotide
taatacgactcactatagggcgcaggatccagaagttcctgttgcgcagcaacagaggagagctgcgatgcaggaacttaacctggcggcagcgcaaaagatg

SEQ ID NO: 243103 - DNA, 103 bp, Artificial Sequence
  Synthetic Polynucleotide
taatacgactcactatagggcgggggcagccgcaggatccagaagttcctaacagaggagaaggaacatgtggatcctgaacctggcggcagcgcaaaagatg

SEQ ID NO: 243104 - DNA, 103 bp, Artificial Sequence
  Synthetic Polynucleotide
taatacgactcactatagggccttgctgcccgggggcagccgcaggatccaacagaggagaggatccatgggctgccccaacctggcggcagcgcaaaagatg

SEQ ID NO: 243105 - DNA, 103 bp, Artificial Sequence
  Synthetic Polynucleotide
taatacgactcactataggggtggctgccatcgtccacggagaaatcggaaacagaggagatccgatatgtccgtggacaacctggcggcagcgcaaaagatg

SEQ ID NO: 243106 - DNA, 103 bp, Artificial Sequence
  Synthetic Polynucleotide
taatacgactcactatagggggggactcccccttgctgcccgggggcagcaacagaggagagctgccatggggcagcaaaacctggcggcagcgcaaaagatg

SEQ ID NO: 243107 - DNA, 103 bp, Artificial Sequence
  Synthetic Polynucleotide
taatacgactcactatagggccactccttaggggactcccccttgctgccaacagaggagaggcagcatgggggagtccaacctggcggcagcgcaaaagatg

SEQ ID NO: 243108 - DNA, 103 bp, Artificial Sequence
  Synthetic Polynucleotide
taatacgactcactatagggccagcttgccccactccttaggggactcccaacagaggagagggagtatgctaaggagtaacctggcggcagcgcaaaagatg

SEQ ID NO: 243109 - DNA, 103 bp, Artificial Sequence
  Synthetic Polynucleotide
taatacgactcactatagggtgccagtcctccagcttgccccactccttaaacagaggagataaggaatggggcaagctaacctggcggcagcgcaaaagatg

SEQ ID NO: 243110 - DNA, 103 bp, Artificial Sequence
  Synthetic Polynucleotide
taatacgactcactataggggagctccttctgccagtcctccagcttgccaacagaggagaggcaagatggaggactggaacctggcggcagcgcaaaagatg

SEQ ID NO: 243111 - DNA, 103 bp, Artificial Sequence
  Synthetic Polynucleotide
taatacgactcactatagggcgtgcttgtagagctccttctgccagtcctaacagaggagaaggactatgagaaggagcaacctggcggcagcgcaaaagatg

SEQ ID NO: 243112 - DNA, 103 bp, Artificial Sequence
  Synthetic Polynucleotide
taatacgactcactatagggcccctcatcacgtgcttgtagagctccttcaacagaggagagaaggaatgctacaagcaaacctggcggcagcgcaaaagatg

SEQ ID NO: 243113 - DNA, 103 bp, Artificial Sequence
  Synthetic Polynucleotide
taatacgactcactatagggctcgtagttgcccctcatcacgtgcttgtaaacagaggagatacaagatggtgatgaggaacctggcggcagcgcaaaagatg

SEQ ID NO: 243114 - DNA, 103 bp, Artificial Sequence
  Synthetic Polynucleotide
taatacgactcactatagggagaccagcgtctcgtagttgcccctcatcaaacagaggagatgatgaatggcaactacgaacctggcggcagcgcaaaagatg

SEQ ID NO: 243115 - DNA, 103 bp, Artificial Sequence
  Synthetic Polynucleotide
taatacgactcactatagggtagtccagggagaccagcgtctcgtagttgaacagaggagacaactaatggacgctggtaacctggcggcagcgcaaaagatg

SEQ ID NO: 243116 - DNA, 103 bp, Artificial Sequence
  Synthetic Polynucleotide
taatacgactcactatagggggcctgaatcgtggctgccatcgtccacggaacagaggagaccgtggatgatggcagccaacctggcggcagcgcaaaagatg

SEQ ID NO: 243117 - DNA, 103 bp, Artificial Sequence
  Synthetic Polynucleotide
taatacgactcactatagggggagatggcgtagtccagggagaccagcgtaacagaggagaacgctgatgtccctggacaacctggcggcagcgcaaaagatg

SEQ ID NO: 243118 - DNA, 103 bp, Artificial Sequence
  Synthetic Polynucleotide
taatacgactcactatagggcctcgggcttggagatggcgtagtccagggaacagaggagaccctggatgacgccatctaacctggcggcagcgcaaaagatg

SEQ ID NO: 243119 - DNA, 103 bp, Artificial Sequence
  Synthetic Polynucleotide
taatacgactcactatagggtgggagaggacctcgggcttggagatggcgaacagaggagacgccatatgcaagcccgaaacctggcggcagcgcaaaagatg

SEQ ID NO: 243120 - DNA, 103 bp, Artificial Sequence
  Synthetic Polynucleotide
taatacgactcactatagggttgttcaatctgggagaggacctcgggcttaacagaggagaaagcccatggtcctctccaacctggcggcagcgcaaaagatg

SEQ ID NO: 243121 - DNA, 103 bp, Artificial Sequence
  Synthetic Polynucleotide
taatacgactcactataggggctccttcccttgttcaatctgggagaggaaacagaggagatcctctatgagattgaacaacctggcggcagcgcaaaagatg

SEQ ID NO: 243122 - DNA, 103 bp, Artificial Sequence
  Synthetic Polynucleotide
taatacgactcactatagggcagttgcagggctccttcccttgttcaatcaacagaggagagattgaatgagggaaggaaacctggcggcagcgcaaaagatg

SEQ ID NO: 243123 - DNA, 103 bp, Artificial Sequence
  Synthetic Polynucleotide
taatacgactcactatagggagggcggcgccagttgcagggctccttcccaacagaggagagggaagatgccctgcaacaacctggcggcagcgcaaaagatg

SEQ ID NO: 243124 - DNA, 103 bp, Artificial Sequence
  Synthetic Polynucleotide
taatacgactcactatagggtcttggggccagggcggcgccagttgcaggaacagaggagacctgcaatgggcgccgccaacctggcggcagcgcaaaagatg

SEQ ID NO: 243125 - DNA, 103 bp, Artificial Sequence
  Synthetic Polynucleotide
taatacgactcactatagggacatctggaatcttggggccagggcggcgcaacagaggagagcgccgatgtggccccaaaacctggcggcagcgcaaaagatg

SEQ ID NO: 243126 - DNA, 103 bp, Artificial Sequence
  Synthetic Polynucleotide
taatacgactcactataggggtccacaggaacatctggaatcttggggccaacagaggagaggccccatgattccagataacctggcggcagcgcaaaagatg

SEQ ID NO: 243127 - DNA, 103 bp, Artificial Sequence
  Synthetic Polynucleotide
taatacgactcactatagggtcctctccatggcctgaatcgtggctgccaaacagaggagatggcagatgcgattcaggaacctggcggcagcgcaaaagatg

SEQ ID NO: 243128 - DNA, 103 bp, Artificial Sequence
  Synthetic Polynucleotide
taatacgactcactatagggctggactggggtccacaggaacatctggaaaacagaggagattccagatgttcctgtggaacctggcggcagcgcaaaagatg

SEQ ID NO: 243129 - DNA, 103 bp, Artificial Sequence
  Synthetic Polynucleotide
taatacgactcactatagggggccccgagcctggactggggtccacaggaaacagaggagatcctgtatgccccagtccaacctggcggcagcgcaaaagatg

SEQ ID NO: 243130 - DNA, 103 bp, Artificial Sequence
  Synthetic Polynucleotide
taatacgactcactataggggggaactgggggccccgagcctggactgggaacagaggagacccagtatgggctcggggaacctggcggcagcgcaaaagatg

SEQ ID NO: 243131 - DNA, 103 bp, Artificial Sequence
  Synthetic Polynucleotide
taatacgactcactatagggggtctggggcgggaactgggggccccgagcaacagaggagagctcggatgccccagttcaacctggcggcagcgcaaaagatg

SEQ ID NO: 243132 - DNA, 103 bp, Artificial Sequence
  Synthetic Polynucleotide
taatacgactcactatagggtgcatcaagaggtctggggcgggaactgggaacagaggagacccagtatgcgccccagaaacctggcggcagcgcaaaagatg

SEQ ID NO: 243133 - DNA, 103 bp, Artificial Sequence
  Synthetic Polynucleotide
taatacgactcactatagggctgcttgatctgcatcaagaggtctggggcaacagaggagagccccaatgctcttgatgaacctggcggcagcgcaaaagatg

SEQ ID NO: 243134 - DNA, 103 bp, Artificial Sequence
  Synthetic Polynucleotide
taatacgactcactataggggctcaccctcctgcttgatctgcatcaagaaacagaggagatcttgaatgagatcaagcaacctggcggcagcgcaaaagatg

SEQ ID NO: 243135 - DNA, 103 bp, Artificial Sequence
  Synthetic Polynucleotide
taatacgactcactatagggtggagctggagctcaccctcctgcttgatcaacagaggagagatcaaatgggagggtgaaacctggcggcagcgcaaaagatg

SEQ ID NO: 243136 - DNA, 103 bp, Artificial Sequence
  Synthetic Polynucleotide
taatacgactcactatagggctgctgctcctggagctggagctcaccctcaacagaggagagagggtatgctccagctcaacctggcggcagcgcaaaagatg

SEQ ID NO: 243137 - DNA, 103 bp, Artificial Sequence
  Synthetic Polynucleotide
taatacgactcactatagggcgcccagggcctgctgctcctggagctggaaacagaggagatccagcatgaggagcagcaacctggcggcagcgcaaaagatg

SEQ ID NO: 243138 - DNA, 103 bp, Artificial Sequence
  Synthetic Polynucleotide
taatacgactcactataggggattcaatcttcctctccatggcctgaatcaacagaggagagattcaatgcatggagagaacctggcggcagcgcaaaagatg

SEQ ID NO: 243139 - DNA, 103 bp, Artificial Sequence
  Synthetic Polynucleotide
taatacgactcactatagggcacgcctccacgcccagggcctgctgctccaacagaggagaggagcaatgggccctgggaacctggcggcagcgcaaaagatg

SEQ ID NO: 243140 - DNA, 103 bp, Artificial Sequence
  Synthetic Polynucleotide
taatacgactcactatagggcccggctgcccacgcctccacgcccagggcaacagaggagagccctgatggtggaggcgaacctggcggcagcgcaaaagatg

SEQ ID NO: 243141 - DNA, 103 bp, Artificial Sequence
  Synthetic Polynucleotide
taatacgactcactatagggtatctggctgcccggctgcccacgcctccaaacagaggagatggaggatggggcagccgaacctggcggcagcgcaaaagatg

SEQ ID NO: 243142 - DNA, 103 bp, Artificial Sequence
  Synthetic Polynucleotide
taatacgactcactatagggtcctccccaatatctggctgcccggctgccaacagaggagaggcagcatggcagccagaaacctggcggcagcgcaaaagatg

SEQ ID NO: 243143 - DNA, 103 bp, Artificial Sequence
  Synthetic Polynucleotide
taatacgactcactataggggccccagggctcctccccaatatctggctgaacagaggagacagccaatgattggggagaacctggcggcagcgcaaaagatg

SEQ ID NO: 243144 - DNA, 103 bp, Artificial Sequence
  Synthetic Polynucleotide
taatacgactcactataggggctggctgaggccccagggctcctccccaaaacagaggagattggggatgagccctgggaacctggcggcagcgcaaaagatg

SEQ ID NO: 243145 - DNA, 103 bp, Artificial Sequence
  Synthetic Polynucleotide
taatacgactcactatagggccggaatccagctggctgaggccccagggcaacagaggagagccctgatgcctcagccaaacctggcggcagcgcaaaagatg

SEQ ID NO: 243146 - DNA, 103 bp, Artificial Sequence
  Synthetic Polynucleotide
taatacgactcactataggggtctcctgctccggaatccagctggctgagaacagaggagactcagcatgctggattccaacctggcggcagcgcaaaagatg

SEQ ID NO: 243147 - DNA, 103 bp, Artificial Sequence
  Synthetic Polynucleotide
taatacgactcactatagggccgtggagatgtctcctgctccggaatccaaacagaggagatggattatggagcaggagaacctggcggcagcgcaaaagatg

SEQ ID NO: 243148 - DNA, 103 bp, Artificial Sequence
  Synthetic Polynucleotide
taatacgactcactataggggaggtggcatccgtggagatgtctcctgctaacagaggagaagcaggatgcatctccacaacctggcggcagcgcaaaagatg

SEQ ID NO: 243149 - DNA, 103 bp, Artificial Sequence
  Synthetic Polynucleotide
taatacgactcactatagggagcagcctgcgattcaatcttcctctccataacagaggagaatggagatgaagattgaaaacctggcggcagcgcaaaagatg

SEQ ID NO: 243150 - DNA, 103 bp, Artificial Sequence
  Synthetic Polynucleotide
taatacgactcactatagggatggacaccagaggtggcatccgtggagataacagaggagaatctccatggatgccaccaacctggcggcagcgcaaaagatg

SEQ ID NO: 243151 - DNA, 103 bp, Artificial Sequence
  Synthetic Polynucleotide
taatacgactcactatagggaaaagttggaatggacaccagaggtggcataacagaggagaatgccaatgctggtgtccaacctggcggcagcgcaaaagatg

SEQ ID NO: 243152 - DNA, 103 bp, Artificial Sequence
  Synthetic Polynucleotide
taatacgactcactatagggatggtggtggaaaagttggaatggacaccaaacagaggagatggtgtatgttccaacttaacctggcggcagcgcaaaagatg

SEQ ID NO: 243153 - DNA, 103 bp, Artificial Sequence
  Synthetic Polynucleotide
taatacgactcactatagggggtgggcgggatggtggtggaaaagttggaaacagaggagatccaacatgtccaccaccaacctggcggcagcgcaaaagatg

SEQ ID NO: 243154 - DNA, 103 bp, Artificial Sequence
  Synthetic Polynucleotide
taatacgactcactatagggtttgccaggaggtgggcgggatggtggtggaacagaggagaccaccaatgtcccgcccaaacctggcggcagcgcaaaagatg

SEQ ID NO: 243155 - DNA, 103 bp, Artificial Sequence
  Synthetic Polynucleotide
taatacgactcactataggggggagatccgtttgccaggaggtgggcgggaacagaggagacccgccatgctcctggcaaacctggcggcagcgcaaaagatg

SEQ ID NO: 243156 - DNA, 103 bp, Artificial Sequence
  Synthetic Polynucleotide
taatacgactcactatagggatggtggggagggagatccgtttgccaggaaacagaggagatcctggatgacggatctcaacctggcggcagcgcaaaagatg

SEQ ID NO: 243157 - DNA, 103 bp, Artificial Sequence
  Synthetic Polynucleotide
taatacgactcactatagggctgaagagggatggtggggagggagatccgaacagaggagacggatcatgctccccaccaacctggcggcagcgcaaaagatg

SEQ ID NO: 243158 - DNA, 103 bp, Artificial Sequence
  Synthetic Polynucleotide
taatacgactcactatagggtccgagcatgctgaagagggatggtggggaaacagaggagatccccaatgtccctcttcaacctggcggcagcgcaaaagatg

SEQ ID NO: 243159 - DNA, 103 bp, Artificial Sequence
  Synthetic Polynucleotide
taatacgactcactatagggcagggtcccgtccgagcatgctgaagagggaacagaggagaccctctatggcatgctcgaacctggcggcagcgcaaaagatg

SEQ ID NO: 243160 - DNA, 103 bp, Artificial Sequence
  Synthetic Polynucleotide
taatacgactcactatagggaaagcaggcgagcagcctgcgattcaatctaacagaggagaagattgatgcgcaggctgaacctggcggcagcgcaaaagatg

SEQ ID NO: 243161 - DNA, 103 bp, Artificial Sequence
  Synthetic Polynucleotide
taatacgactcactatagggtgttgagcttcagggtcccgtccgagcatgaacagaggagacatgctatgacgggacccaacctggcggcagcgcaaaagatg

SEQ ID NO: 243162 - DNA, 103 bp, Artificial Sequence
  Synthetic Polynucleotide
taatacgactcactataggggaggctgctgtgttgagcttcagggtcccgaacagaggagacgggacatggaagctcaaaacctggcggcagcgcaaaagatg

SEQ ID NO: 243163 - DNA, 103 bp, Artificial Sequence
  Synthetic Polynucleotide
taatacgactcactatagggatcttccgtggaggctgctgtgttgagcttaacagaggagaaagctcatgacagcagccaacctggcggcagcgcaaaagatg

SEQ ID NO: 243164 - DNA, 103 bp, Artificial Sequence
  Synthetic Polynucleotide
taatacgactcactatagggcaatttttacatcttccgtggaggctgctgaacagaggagacagcagatgccacggaagaacctggcggcagcgcaaaagatg

SEQ ID NO: 243165 - DNA, 103 bp, Artificial Sequence
  Synthetic Polynucleotide
taatacgactcactataggggtttttattacaatttttacatcttccgtgaacagaggagacacggaatgtgtaaaaataacctggcggcagcgcaaaagatg

SEQ ID NO: 243166 - DNA, 103 bp, Artificial Sequence
  Synthetic Polynucleotide
taatacgactcactatagggctggacttctgtttttattacaatttttacaacagaggagagtaaaaatggtaataaaaaacctggcggcagcgcaaaagatg

SEQ ID NO: 243167 - DNA, 103 bp, Artificial Sequence
  Synthetic Polynucleotide
taatacgactcactatagggcctcctcttcctggacttctgtttttattaaacagaggagataataaatgcagaagtccaacctggcggcagcgcaaaagatg

SEQ ID NO: 243168 - DNA, 103 bp, Artificial Sequence
  Synthetic Polynucleotide
taatacgactcactataggggtggccaccacctcctcttcctggacttctaacagaggagaagaagtatgggaagaggaaacctggcggcagcgcaaaagatg

SEQ ID NO: 243169 - DNA, 103 bp, Artificial Sequence
  Synthetic Polynucleotide
taatacgactcactatagggatgtacgggtgtggccaccacctcctcttcaacagaggagagaagagatggtggtggccaacctggcggcagcgcaaaagatg

SEQ ID NO: 243170 - DNA, 103 bp, Artificial Sequence
  Synthetic Polynucleotide
taatacgactcactatagggggtcagtaggatgtacgggtgtggccaccaaacagaggagatggtggatgcacccgtacaacctggcggcagcgcaaaagatg

SEQ ID NO: 243171 - DNA, 103 bp, Artificial Sequence
  Synthetic Polynucleotide
taatacgactcactatagggccttctagggaaagcaggcgagcagcctgcaacagaggagagcaggcatgtcgcctgctaacctggcggcagcgcaaaagatg

SEQ ID NO: 243172 - DNA, 103 bp, Artificial Sequence
  Synthetic Polynucleotide
taatacgactcactatagggtgagcctctaggtcagtaggatgtacgggtaacagaggagaacccgtatgtcctactgaaacctggcggcagcgcaaaagatg

SEQ ID NO: 243173 - DNA, 103 bp, Artificial Sequence
  Synthetic Polynucleotide
taatacgactcactatagggcagggtcccgtgagcctctaggtcagtaggaacagaggagacctactatgctagaggctaacctggcggcagcgcaaaagatg

SEQ ID NO: 243174 - DNA, 103 bp, Artificial Sequence
  Synthetic Polynucleotide
taatacgactcactatagggctggtccaaacagggtcccgtgagcctctaaacagaggagatagaggatgacgggacccaacctggcggcagcgcaaaagatg

SEQ ID NO: 243175 - DNA, 103 bp, Artificial Sequence
  Synthetic Polynucleotide
taatacgactcactataggggtggcttggcctggtccaaacagggtcccgaacagaggagacgggacatggtttggaccaacctggcggcagcgcaaaagatg

SEQ ID NO: 243176 - DNA, 103 bp, Artificial Sequence
  Synthetic Polynucleotide
taatacgactcactataggggaagaaccgtgtggcttggcctggtccaaaaacagaggagatttggaatgggccaagccaacctggcggcagcgcaaaagatg

SEQ ID NO: 243177 - DNA, 103 bp, Artificial Sequence
  Synthetic Polynucleotide
taatacgactcactatagggcaggactagggaagaaccgtgtggcttggcaacagaggagagccaagatgcacggttctaacctggcggcagcgcaaaagatg

SEQ ID NO: 243178 - DNA, 103 bp, Artificial Sequence
  Synthetic Polynucleotide
taatacgactcactatagggccttcctgggcaggactagggaagaaccgtaacagaggagaacggttatgccctagtccaacctggcggcagcgcaaaagatg

SEQ ID NO: 243179 - DNA, 103 bp, Artificial Sequence
  Synthetic Polynucleotide
taatacgactcactatagggttcccaggctccttcctgggcaggactaggaacagaggagacctagtatggcccaggaaaacctggcggcagcgcaaaagatg

SEQ ID NO: 243180 - DNA, 103 bp, Artificial Sequence
  Synthetic Polynucleotide
taatacgactcactatagggtgccctggctttcccaggctccttcctgggaacagaggagacccaggatggagcctgggaacctggcggcagcgcaaaagatg

SEQ ID NO: 243181 - DNA, 103 bp, Artificial Sequence
  Synthetic Polynucleotide
taatacgactcactataggggggaaggagctgccctggctttcccaggctaacagaggagaagcctgatgaagccagggaacctggcggcagcgcaaaagatg

SEQ ID NO: 243182 - DNA, 103 bp, Artificial Sequence
  Synthetic Polynucleotide
taatacgactcactatagggttttggcttccgctctttgaggagactcataacagaggagaatgagtatgctcaaagagaacctggcggcagcgcaaaagatg

SEQ ID NO: 243183 - DNA, 103 bp, Artificial Sequence
  Synthetic Polynucleotide
taatacgactcactatagggaagatgtgacttctcattgcaagtaaagggaacagaggagaccctttatgtgcaatgagaacctggcggcagcgcaaaagatg

SEQ ID NO: 243184 - DNA, 103 bp, Artificial Sequence
  Synthetic Polynucleotide
taatacgactcactataggggccagtgacaggtgggagtctgagaccataaacagaggagatatggtatgagactcccaaacctggcggcagcgcaaaagatg

SEQ ID NO: 243185 - DNA, 103 bp, Artificial Sequence
  Synthetic Polynucleotide
taatacgactcactatagggctcgggtgaggccagtgacaggtgggagtcaacagaggagagactccatgctgtcactgaacctggcggcagcgcaaaagatg

SEQ ID NO: 243186 - DNA, 103 bp, Artificial Sequence
  Synthetic Polynucleotide
taatacgactcactataggggagctctgatctcgggtgaggccagtgacaaacagaggagatgtcacatgcctcacccgaacctggcggcagcgcaaaagatg

SEQ ID NO: 243187 - DNA, 103 bp, Artificial Sequence
  Synthetic Polynucleotide
taatacgactcactatagggaagcaggtgagagctctgatctcgggtgagaacagaggagactcaccatggatcagagcaacctggcggcagcgcaaaagatg

SEQ ID NO: 243188 - DNA, 103 bp, Artificial Sequence
  Synthetic Polynucleotide
taatacgactcactatagggtggcttcttcaagcaggtgagagctctgataacagaggagaatcagaatgctcacctgcaacctggcggcagcgcaaaagatg

SEQ ID NO: 243189 - DNA, 103 bp, Artificial Sequence
  Synthetic Polynucleotide
taatacgactcactatagggtagaccagggtggcttcttcaagcaggtgaaacagaggagatcacctatgtgaagaagcaacctggcggcagcgcaaaagatg

SEQ ID NO: 243190 - DNA, 103 bp, Artificial Sequence
  Synthetic Polynucleotide
taatacgactcactatagggcgaggctggatagaccagggtggcttcttcaacagaggagagaagaaatgaccctggtcaacctggcggcagcgcaaaagatg

SEQ ID NO: 243191 - DNA, 103 bp, Artificial Sequence
  Synthetic Polynucleotide
taatacgactcactatagggtggaaggactcgaggctggatagaccagggaacagaggagaccctggatgatccagcctaacctggcggcagcgcaaaagatg

SEQ ID NO: 243192 - DNA, 103 bp, Artificial Sequence
  Synthetic Polynucleotide
taatacgactcactataggggggtttaacctggaaggactcgaggctggaaacagaggagatccagcatggagtccttcaacctggcggcagcgcaaaagatg

SEQ ID NO: 243193 - DNA, 103 bp, Artificial Sequence
  Synthetic Polynucleotide
taatacgactcactatagggggggtccgaagggtttaacctggaaggactaacagaggagaagtcctatgaggttaaacaacctggcggcagcgcaaaagatg

SEQ ID NO: 243194 - DNA, 103 bp, Artificial Sequence
  Synthetic Polynucleotide
taatacgactcactatagggtgtgattaaaaagatgtgacttctcattgcaacagaggagagcaatgatgagtcacatcaacctggcggcagcgcaaaagatg

SEQ ID NO: 243195 - DNA, 103 bp, Artificial Sequence
  Synthetic Polynucleotide
taatacgactcactataggggttttctgttggggtccgaagggtttaaccaacagaggagaggttaaatgcttcggaccaacctggcggcagcgcaaaagatg

SEQ ID NO: 243196 - DNA, 103 bp, Artificial Sequence
  Synthetic Polynucleotide
taatacgactcactatagggaactcgacgtgttttctgttggggtccgaaaacagaggagattcggaatgcaacagaaaaacctggcggcagcgcaaaagatg

SEQ ID NO: 243197 - DNA, 103 bp, Artificial Sequence
  Synthetic Polynucleotide
taatacgactcactatagggtggactttcgaactcgacgtgttttctgttaacagaggagaaacagaatgcacgtcgagaacctggcggcagcgcaaaagatg

SEQ ID NO: 243198 - DNA, 103 bp, Artificial Sequence
  Synthetic Polynucleotide
taatacgactcactatagggcctcaggaattggactttcgaactcgacgtaacagaggagaacgtcgatgtcgaaagtcaacctggcggcagcgcaaaagatg

SEQ ID NO: 243199 - DNA, 103 bp, Artificial Sequence
  Synthetic Polynucleotide
taatacgactcactataggggagtctttagcctcaggaattggactttcgaacagaggagacgaaagatgaattcctgaaacctggcggcagcgcaaaagatg

SEQ ID NO: 243200 - DNA, 103 bp, Artificial Sequence
  Synthetic Polynucleotide
taatacgactcactatagggagccttggaggagtctttagcctcaggaataacagaggagaattcctatggctaaagacaacctggcggcagcgcaaaagatg

SEQ ID NO: 243201 - DNA, 103 bp, Artificial Sequence
  Synthetic Polynucleotide
taatacgactcactatagggctctctgcccagccttggaggagtctttagaacagaggagactaaagatgcctccaaggaacctggcggcagcgcaaaagatg

SEQ ID NO: 243202 - DNA, 103 bp, Artificial Sequence
  Synthetic Polynucleotide
taatacgactcactatagggccttccgtgtctctctgcccagccttggagaacagaggagactccaaatgtgggcagagaacctggcggcagcgcaaaagatg

SEQ ID NO: 243203 - DNA, 103 bp, Artificial Sequence
  Synthetic Polynucleotide
taatacgactcactatagggcattttggacccttccgtgtctctctgcccaacagaggagagggcagatggacacggaaaacctggcggcagcgcaaaagatg

SEQ ID NO: 243204 - DNA, 103 bp, Artificial Sequence
  Synthetic Polynucleotide
taatacgactcactatagggcgcgggggctcattttggacccttccgtgtaacagaggagaacacggatgggtccaaaaaacctggcggcagcgcaaaagatg

SEQ ID NO: 243205 - DNA, 103 bp, Artificial Sequence
  Synthetic Polynucleotide
taatacgactcactatagggccatacttcatgtgattaaaaagatgtgacaacagaggagagtcacaatgttttaatcaaacctggcggcagcgcaaaagatg

SEQ ID NO: 243206 - DNA, 103 bp, Artificial Sequence
  Synthetic Polynucleotide
taatacgactcactataggggcactccctgcgcgggggctcattttggacaacagaggagagtccaaatggagcccccgaacctggcggcagcgcaaaagatg

SEQ ID NO: 243207 - DNA, 103 bp, Artificial Sequence
  Synthetic Polynucleotide
taatacgactcactataggggcccgtggctgcactccctgcgcgggggctaacagaggagaagccccatggcagggagtaacctggcggcagcgcaaaagatg

SEQ ID NO: 243208 - DNA, 103 bp, Artificial Sequence
  Synthetic Polynucleotide
taatacgactcactatagggtccctggggagcccgtggctgcactccctgaacagaggagacagggaatgcagccacggaacctggcggcagcgcaaaagatg

SEQ ID NO: 243209 - DNA, 103 bp, Artificial Sequence
  Synthetic Polynucleotide
taatacgactcactataggggggctcggcctccctggggagcccgtggctaacagaggagaagccacatgctccccaggaacctggcggcagcgcaaaagatg

SEQ ID NO: 243210 - DNA, 103 bp, Artificial Sequence
  Synthetic Polynucleotide
taatacgactcactataggggaagtcggtggggctcggcctccctggggaaacagaggagatccccaatgaggccgagcaacctggcggcagcgcaaaagatg

SEQ ID NO: 243211 - DNA, 103 bp, Artificial Sequence
  Synthetic Polynucleotide
taatacgactcactatagggtcgtctgcatgaagtcggtggggctcggccaacagaggagaggccgaatgccaccgactaacctggcggcagcgcaaaagatg

SEQ ID NO: 243212 - DNA, 103 bp, Artificial Sequence
  Synthetic Polynucleotide
taatacgactcactatagggcaggtctggctcgtctgcatgaagtcggtgaacagaggagacaccgaatgcatgcagacaacctggcggcagcgcaaaagatg

SEQ ID NO: 243213 - DNA, 103 bp, Artificial Sequence
  Synthetic Polynucleotide
taatacgactcactatagggcaggccttcgcaggtctggctcgtctgcataacagaggagaatgcagatgagccagaccaacctggcggcagcgcaaaagatg

SEQ ID NO: 243214 - DNA, 103 bp, Artificial Sequence
  Synthetic Polynucleotide
taatacgactcactatagggagaggtcgtacaggccttcgcaggtctggcaacagaggagagccagaatggcgaaggccaacctggcggcagcgcaaaagatg

SEQ ID NO: 243215 - DNA, 103 bp, Artificial Sequence
  Synthetic Polynucleotide
taatacgactcactataggggccttgttggagaggtcgtacaggccttcgaacagaggagacgaaggatggtacgacctaacctggcggcagcgcaaaagatg

SEQ ID NO: 243216 - DNA, 103 bp, Artificial Sequence
  Synthetic Polynucleotide
taatacgactcactatagggtttacaaagaccatacttcatgtgattaaaaacagaggagatttaatatgatgaagtataacctggcggcagcgcaaaagatg

SEQ ID NO: 243217 - DNA, 103 bp, Artificial Sequence
  Synthetic Polynucleotide
taatacgactcactataggggctggaggctgccttgttggagaggtcgtaaacagaggagatacgacatgtccaacaagaacctggcggcagcgcaaaagatg

SEQ ID NO: 243218 - DNA, 103 bp, Artificial Sequence
  Synthetic Polynucleotide
taatacgactcactatagggttcccagtgcgctggaggctgccttgttggaacagaggagaccaacaatgcagcctccaaacctggcggcagcgcaaaagatg

SEQ ID NO: 243219 - DNA, 103 bp, Artificial Sequence
  Synthetic Polynucleotide
taatacgactcactataggggggtagagtcttcccagtgcgctggaggctaacagaggagaagcctcatgcgcactgggaacctggcggcagcgcaaaagatg

SEQ ID NO: 243220 - DNA, 103 bp, Artificial Sequence
  Synthetic Polynucleotide
taatacgactcactatagggttgctctggcgggtagagtcttcccagtgcaacagaggagagcactgatgagactctacaacctggcggcagcgcaaaagatg

SEQ ID NO: 243221 - DNA, 103 bp, Artificial Sequence
  Synthetic Polynucleotide
taatacgactcactatagggctgtgaggctttgctctggcgggtagagtcaacagaggagagactctatgcgccagagcaacctggcggcagcgcaaaagatg

SEQ ID NO: 243222 - DNA, 103 bp, Artificial Sequence
  Synthetic Polynucleotide
taatacgactcactatagggggcctgaaggctgtgaggctttgctctggcaacagaggagagccagaatgaagcctcacaacctggcggcagcgcaaaagatg

SEQ ID NO: 243223 - DNA, 103 bp, Artificial Sequence
  Synthetic Polynucleotide
taatacgactcactatagggtttcttaacaggcctgaaggctgtgaggctaacagaggagaagcctcatggccttcaggaacctggcggcagcgcaaaagatg

SEQ ID NO: 243224 - DNA, 103 bp, Artificial Sequence
  Synthetic Polynucleotide
taatacgactcactatagggattctgtgcttttcttaacaggcctgaaggaacagaggagaccttcaatgctgttaagaaacctggcggcagcgcaaaagatg

SEQ ID NO: 243225 - DNA, 103 bp, Artificial Sequence
  Synthetic Polynucleotide
taatacgactcactataggggcaggtaggcattctgtgcttttcttaacaaacagaggagatgttaaatgaagcacagaaacctggcggcagcgcaaaagatg

SEQ ID NO: 243226 - DNA, 103 bp, Artificial Sequence
  Synthetic Polynucleotide
taatacgactcactatagggagcagcctgggcaggtaggcattctgtgctaacagaggagaagcacaatgtgcctacctaacctggcggcagcgcaaaagatg

SEQ ID NO: 243227 - DNA, 103 bp, Artificial Sequence
  Synthetic Polynucleotide
taatacgactcactatagggtaatcgagtttttacaaagaccatacttcaaacagaggagatgaagtatggtctttgtaaacctggcggcagcgcaaaagatg

SEQ ID NO: 243228 - DNA, 103 bp, Artificial Sequence
  Synthetic Polynucleotide
taatacgactcactatagggctgtggtctcagcagcctgggcaggtaggcaacagaggagagcctacatgcccaggctgaacctggcggcagcgcaaaagatg

SEQ ID NO: 243229 - DNA, 103 bp, Artificial Sequence
  Synthetic Polynucleotide
taatacgactcactatagggggagactctgctgtggtctcagcagcctggaacagaggagaccaggcatgtgagaccacaacctggcggcagcgcaaaagatg

SEQ ID NO: 243230 - DNA, 103 bp, Artificial Sequence
  Synthetic Polynucleotide
taatacgactcactataggggaggcttactggagactctgctgtggtctcaacagaggagagagaccatggcagagtctaacctggcggcagcgcaaaagatg

SEQ ID NO: 243231 - DNA, 103 bp, Artificial Sequence
  Synthetic Polynucleotide
taatacgactcactatagggtcacaacattgaggcttactggagactctgaacagaggagacagagtatgcagtaagccaacctggcggcagcgcaaaagatg

SEQ ID NO: 243232 - DNA, 103 bp, Artificial Sequence
  Synthetic Polynucleotide
taatacgactcactataggggggtctccgttcacaacattgaggcttactaacagaggagaagtaagatgcaatgttgtaacctggcggcagcgcaaaagatg

SEQ ID NO: 243233 - DNA, 103 bp, Artificial Sequence
  Synthetic Polynucleotide
taatacgactcactatagggcggagcaggagggtctccgttcacaacattaacagaggagaaatgttatgaacggagacaacctggcggcagcgcaaaagatg

SEQ ID NO: 243234 - DNA, 103 bp, Artificial Sequence
  Synthetic Polynucleotide
taatacgactcactatagggcgcttccggtcggagcaggagggtctccgtaacagaggagaacggagatgctcctgctcaacctggcggcagcgcaaaagatg

SEQ ID NO: 243235 - DNA, 103 bp, Artificial Sequence
  Synthetic Polynucleotide
taatacgactcactatagggacgagagaggcgcttccggtcggagcaggaaacagaggagatcctgcatggaccggaagaacctggcggcagcgcaaaagatg

SEQ ID NO: 243236 - DNA, 103 bp, Artificial Sequence
  Synthetic Polynucleotide
taatacgactcactatagggggcctccgagacgagagaggcgcttccggtaacagaggagaaccggaatggcctctctcaacctggcggcagcgcaaaagatg

SEQ ID NO: 243237 - DNA, 103 bp, Artificial Sequence
  Synthetic Polynucleotide
taatacgactcactatagggtggaaggcgcggcctccgagacgagagaggaacagaggagacctctcatgtctcggaggaacctggcggcagcgcaaaagatg

SEQ ID NO: 243238 - DNA, 103 bp, Artificial Sequence
  Synthetic Polynucleotide
taatacgactcactataggggatactaaagtaatcgagtttttacaaagaaacagaggagatctttgatgaaactcgataacctggcggcagcgcaaaagatg

SEQ ID NO: 243239 - DNA, 103 bp, Artificial Sequence
  Synthetic Polynucleotide
taatacgactcactatagggtcgtccggactggaaggcgcggcctccgagaacagaggagactcggaatgcgcgccttcaacctggcggcagcgcaaaagatg

SEQ ID NO: 243240 - DNA, 103 bp, Artificial Sequence
  Synthetic Polynucleotide
taatacgactcactatagggcccggagctgtcgtccggactggaaggcgcaacagaggagagcgcctatgagtccggacaacctggcggcagcgcaaaagatg

SEQ ID NO: 243241 - DNA, 103 bp, Artificial Sequence
  Synthetic Polynucleotide
taatacgactcactataggggggggcccatcccggagctgtcgtccggacaacagaggagagtccggatgacagctccgaacctggcggcagcgcaaaagatg

SEQ ID NO: 243242 - DNA, 103 bp, Artificial Sequence
  Synthetic Polynucleotide
taatacgactcactataggggagaggttgagggggcccatcccggagctgaacagaggagacagctcatggatgggcccaacctggcggcagcgcaaaagatg

SEQ ID NO: 243243 - DNA, 103 bp, Artificial Sequence
  Synthetic Polynucleotide
taatacgactcactatagggtgatttcttggagaggttgagggggcccataacagaggagaatgggcatgctcaacctcaacctggcggcagcgcaaaagatg

SEQ ID NO: 243244 - DNA, 103 bp, Artificial Sequence
  Synthetic Polynucleotide
taatacgactcactatagggggtttatctctgatttcttggagaggttgaaacagaggagatcaaccatgccaagaaataacctggcggcagcgcaaaagatg

SEQ ID NO: 243245 - DNA, 103 bp, Artificial Sequence
  Synthetic Polynucleotide
taatacgactcactataggggtggctgccaggtttatctctgatttcttgaacagaggagacaagaaatgagagataaaaacctggcggcagcgcaaaagatg

SEQ ID NO: 243246 - DNA, 103 bp, Artificial Sequence
  Synthetic Polynucleotide
taatacgactcactataggggggttcgtgggtggctgccaggtttatctcaacagaggagagagataatgctggcagccaacctggcggcagcgcaaaagatg

SEQ ID NO: 243247 - DNA, 103 bp, Artificial Sequence
  Synthetic Polynucleotide
taatacgactcactatagggcttggtacgtgggttcgtgggtggctgccaaacagaggagatggcagatgcccacgaacaacctggcggcagcgcaaaagatg

SEQ ID NO: 243248 - DNA, 103 bp, Artificial Sequence
  Synthetic Polynucleotide
taatacgactcactatagggtgggggctgccttggtacgtgggttcgtggaacagaggagaccacgaatgcacgtaccaaacctggcggcagcgcaaaagatg

SEQ ID NO: 243249 - DNA, 103 bp, Artificial Sequence
  Synthetic Polynucleotide
taatacgactcactatagggatcctgctctgatactaaagtaatcgagttaacagaggagaaactcgatgactttagtaaacctggcggcagcgcaaaagatg

SEQ ID NO: 243250 - DNA, 103 bp, Artificial Sequence
  Synthetic Polynucleotide
taatacgactcactatagggggtttccgcctgggggctgccttggtacgtaacagaggagaacgtacatgggcagccccaacctggcggcagcgcaaaagatg

SEQ ID NO: 243251 - DNA, 103 bp, Artificial Sequence
  Synthetic Polynucleotide
taatacgactcactatagggagaagctggcggtttccgcctgggggctgcaacagaggagagcagccatgaggcggaaaaacctggcggcagcgcaaaagatg

SEQ ID NO: 243252 - DNA, 103 bp, Artificial Sequence
  Synthetic Polynucleotide
taatacgactcactatagggtgcagctctgagaagctggcggtttccgccaacagaggagaggcggaatgcgccagcttaacctggcggcagcgcaaaagatg

SEQ ID NO: 243253 - DNA, 103 bp, Artificial Sequence
  Synthetic Polynucleotide
taatacgactcactatagggtggaaggtcctgcagctctgagaagctggcaacagaggagagccagcatgtcagagctgaacctggcggcagcgcaaaagatg

SEQ ID NO: 243254 - DNA, 103 bp, Artificial Sequence
  Synthetic Polynucleotide
taatacgactcactatagggagagattgagtggaaggtcctgcagctctgaacagaggagacagagcatgaggaccttcaacctggcggcagcgcaaaagatg

SEQ ID NO: 243255 - DNA, 103 bp, Artificial Sequence
  Synthetic Polynucleotide
taatacgactcactatagggtccttcaccgagagattgagtggaaggtccaacagaggagaggacctatgactcaatctaacctggcggcagcgcaaaagatg

SEQ ID NO: 243256 - DNA, 103 bp, Artificial Sequence
  Synthetic Polynucleotide
taatacgactcactataggggttacaggggtccttcaccgagagattgagaacagaggagactcaatatgtcggtgaagaacctggcggcagcgcaaaagatg

SEQ ID NO: 243257 - DNA, 103 bp, Artificial Sequence
  Synthetic Polynucleotide
taatacgactcactataggggagcctgggtgttacaggggtccttcaccgaacagaggagacggtgaatgacccctgtaaacctggcggcagcgcaaaagatg

SEQ ID NO: 243258 - DNA, 103 bp, Artificial Sequence
  Synthetic Polynucleotide
taatacgactcactataggggcaggcctcggagcctgggtgttacaggggaacagaggagacccctgatgcacccaggcaacctggcggcagcgcaaaagatg

SEQ ID NO: 243259 - DNA, 103 bp, Artificial Sequence
  Synthetic Polynucleotide
taatacgactcactatagggaccggggaaggcaggcctcggagcctgggtaacagaggagaacccagatgccgaggcctaacctggcggcagcgcaaaagatg

SEQ ID NO: 243260 - DNA, 103 bp, Artificial Sequence
  Synthetic Polynucleotide
taatacgactcactatagggtgggaactcgatcctgctctgatactaaagaacagaggagactttagatgcagagcaggaacctggcggcagcgcaaaagatg

SEQ ID NO: 243261 - DNA, 103 bp, Artificial Sequence
  Synthetic Polynucleotide
taatacgactcactatagggctcgtggtcgaccggggaaggcaggcctcgaacagaggagacgaggcatgccttccccgaacctggcggcagcgcaaaagatg

SEQ ID NO: 243262 - DNA, 103 bp, Artificial Sequence
  Synthetic Polynucleotide
taatacgactcactatagggggttctgcagctcgtggtcgaccggggaagaacagaggagacttcccatgtcgaccacgaacctggcggcagcgcaaaagatg

SEQ ID NO: 243263 - DNA, 103 bp, Artificial Sequence
  Synthetic Polynucleotide
taatacgactcactatagggagcagcagcaggttctgcagctcgtggtcgaacagaggagacgaccaatggctgcagaaaacctggcggcagcgcaaaagatg

SEQ ID NO: 243264 - DNA, 103 bp, Artificial Sequence
  Synthetic Polynucleotide
taatacgactcactatagggtctgtggaacagcagcagcaggttctgcagaacagaggagactgcagatgctgctgctgaacctggcggcagcgcaaaagatg

SEQ ID NO: 243265 - DNA, 103 bp, Artificial Sequence
  Synthetic Polynucleotide
taatacgactcactataggggtcccagtcttctgtggaacagcagcagcaaacagaggagatgctgcatgtgttccacaaacctggcggcagcgcaaaagatg

SEQ ID NO: 243266 - DNA, 103 bp, Artificial Sequence
  Synthetic Polynucleotide
taatacgactcactatagggagaaccttctgtcccagtcttctgtggaacaacagaggagagttccaatgaagactgggaacctggcggcagcgcaaaagatg

SEQ ID NO: 243267 - DNA, 103 bp, Artificial Sequence
  Synthetic Polynucleotide
taatacgactcactataggggcccatcctcagaaccttctgtcccagtctaacagaggagaagactgatgcagaaggttaacctggcggcagcgcaaaagatg

SEQ ID NO: 243268 - DNA, 103 bp, Artificial Sequence
  Synthetic Polynucleotide
taatacgactcactataggggggtggctgggcccatcctcagaaccttctaacagaggagaagaaggatgtgaggatggaacctggcggcagcgcaaaagatg

SEQ ID NO: 243269 - DNA, 103 bp, Artificial Sequence
  Synthetic Polynucleotide
taatacgactcactatagggcttggtctcagggtggctgggcccatcctcaacagaggagagaggatatgcccagccacaacctggcggcagcgcaaaagatg

SEQ ID NO: 243270 - DNA, 103 bp, Artificial Sequence
  Synthetic Polynucleotide
taatacgactcactatagggggctgcctggcttggtctcagggtggctggaacagaggagaccagccatgctgagaccaaacctggcggcagcgcaaaagatg

SEQ ID NO: 243271 - DNA, 103 bp, Artificial Sequence
  Synthetic Polynucleotide
taatacgactcactatagggttagggcacttgggaactcgatcctgctctaacagaggagaagagcaatgtcgagttccaacctggcggcagcgcaaaagatg

SEQ ID NO: 243272 - DNA, 103 bp, Artificial Sequence
  Synthetic Polynucleotide
taatacgactcactatagggtcaccgtcgaggctgcctggcttggtctcaaacagaggagatgagacatggccaggcagaacctggcggcagcgcaaaagatg

SEQ ID NO: 243273 - DNA, 103 bp, Artificial Sequence
  Synthetic Polynucleotide
taatacgactcactatagggtggggccccgtcaccgtcgaggctgcctggaacagaggagaccaggcatgctcgacggtaacctggcggcagcgcaaaagatg

SEQ ID NO: 243274 - DNA, 103 bp, Artificial Sequence
  Synthetic Polynucleotide
taatacgactcactatagggggcctgtgggtggggccccgtcaccgtcgaaacagaggagatcgacgatgacggggcccaacctggcggcagcgcaaaagatg

SEQ ID NO: 243275 - DNA, 103 bp, Artificial Sequence
  Synthetic Polynucleotide
taatacgactcactatagggtcctcgccggggcctgtgggtggggccccgaacagaggagacggggcatgacccacaggaacctggcggcagcgcaaaagatg

SEQ ID NO: 243276 - DNA, 103 bp, Artificial Sequence
  Synthetic Polynucleotide
taatacgactcactataggggtctggagcctcctcgccggggcctgtgggaacagaggagacccacaatgcccggcgagaacctggcggcagcgcaaaagatg

SEQ ID NO: 243277 - DNA, 103 bp, Artificial Sequence
  Synthetic Polynucleotide
taatacgactcactatagggccgcgcatgcgtctggagcctcctcgccggaacagaggagaccggcgatgaggctccagaacctggcggcagcgcaaaagatg

SEQ ID NO: 243278 - DNA, 103 bp, Artificial Sequence
  Synthetic Polynucleotide
taatacgactcactatagggctgctgtccaccgcgcatgcgtctggagccaacagaggagaggctccatgcgcatgcgcaacctggcggcagcgcaaaagatg

SEQ ID NO: 243279 - DNA, 103 bp, Artificial Sequence
  Synthetic Polynucleotide
taatacgactcactatagggctgctcctcgctgctgtccaccgcgcatgcaacagaggagagcatgcatggtggacagcaacctggcggcagcgcaaaagatg

SEQ ID NO: 243280 - DNA, 103 bp, Artificial Sequence
  Synthetic Polynucleotide
taatacgactcactatagggccgtctgcttctgctcctcgctgctgtccaaacagaggagatggacaatggcgaggagcaacctggcggcagcgcaaaagatg

SEQ ID NO: 243281 - DNA, 103 bp, Artificial Sequence
  Synthetic Polynucleotide
taatacgactcactataggggccacggctgccgtctgcttctgctcctcgaacagaggagacgaggaatggaagcagacaacctggcggcagcgcaaaagatg

SEQ ID NO: 243282 - DNA, 103 bp, Artificial Sequence
  Synthetic Polynucleotide
taatacgactcactatagggtgagttagatttagggcacttgggaactcgaacagaggagacgagttatgaagtgccctaacctggcggcagcgcaaaagatg

SEQ ID NO: 243283 - DNA, 103 bp, Artificial Sequence
  Synthetic Polynucleotide
taatacgactcactatagggctggcacagggccacggctgccgtctgcttaacagaggagaaagcagatggcagccgtgaacctggcggcagcgcaaaagatg

SEQ ID NO: 243284 - DNA, 103 bp, Artificial Sequence
  Synthetic Polynucleotide
taatacgactcactatagggaggccgccagctggcacagggccacggctgaacagaggagacagccgatgccctgtgccaacctggcggcagcgcaaaagatg

SEQ ID NO: 243285 - DNA, 103 bp, Artificial Sequence
  Synthetic Polynucleotide
taatacgactcactatagggctggggctgtaggccgccagctggcacaggaacagaggagacctgtgatggctggcggcaacctggcggcagcgcaaaagatg

SEQ ID NO: 243286 - DNA, 103 bp, Artificial Sequence
  Synthetic Polynucleotide
taatacgactcactatagggccggatgttcctggggctgtaggccgccagaacagaggagactggcgatgtacagccccaacctggcggcagcgcaaaagatg

SEQ ID NO: 243287 - DNA, 103 bp, Artificial Sequence
  Synthetic Polynucleotide
taatacgactcactatagggcatcgcccacccggatgttcctggggctgtaacagaggagaacagccatgggaacatccaacctggcggcagcgcaaaagatg

SEQ ID NO: 243288 - DNA, 103 bp, Artificial Sequence
  Synthetic Polynucleotide
taatacgactcactataggggcagcatccccatcgcccacccggatgttcaacagaggagagaacatatgggtgggcgaaacctggcggcagcgcaaaagatg

SEQ ID NO: 243289 - DNA, 103 bp, Artificial Sequence
  Synthetic Polynucleotide
taatacgactcactatagggttccggggccgcagcatccccatcgcccacaacagaggagagtgggcatgggggatgctaacctggcggcagcgcaaaagatg

SEQ ID NO: 243290 - DNA, 103 bp, Artificial Sequence
  Synthetic Polynucleotide
taatacgactcactatagggggcaggcaggttccggggccgcagcatcccaacagaggagagggatgatgcggccccggaacctggcggcagcgcaaaagatg

SEQ ID NO: 243291 - DNA, 103 bp, Artificial Sequence
  Synthetic Polynucleotide
taatacgactcactataggggtgtcttgccggcaggcaggttccggggccaacagaggagaggccccatgacctgcctgaacctggcggcagcgcaaaagatg

SEQ ID NO: 243292 - DNA, 103 bp, Artificial Sequence
  Synthetic Polynucleotide
taatacgactcactatagggcagtgtgggtgtgtcttgccggcaggcaggaacagaggagacctgccatgcggcaagacaacctggcggcagcgcaaaagatg

SEQ ID NO: 243293 - DNA, 103 bp, Artificial Sequence
  Synthetic Polynucleotide
taatacgactcactatagggaatgtggcttttttggcttccgctctttgaaacagaggagatcaaagatgggaagccaaaacctggcggcagcgcaaaagatg

SEQ ID NO: 243294 - DNA, 103 bp, Artificial Sequence
  Synthetic Polynucleotide
taatacgactcactatagggtggggtctagtgagttagatttagggcactaacagaggagaagtgccatgaatctaactaacctggcggcagcgcaaaagatg

SEQ ID NO: 243295 - DNA, 103 bp, Artificial Sequence
  Synthetic Polynucleotide
taatacgactcactatagggccatggagctcagtgtgggtgtgtcttgccaacagaggagaggcaagatgcacccacacaacctggcggcagcgcaaaagatg

SEQ ID NO: 243296 - DNA, 103 bp, Artificial Sequence
  Synthetic Polynucleotide
taatacgactcactatagggtcttggctctccatggagctcagtgtgggtaacagaggagaacccacatggagctccataacctggcggcagcgcaaaagatg

SEQ ID NO: 243297 - DNA, 103 bp, Artificial Sequence
  Synthetic Polynucleotide
taatacgactcactatagggacactgggcctcttggctctccatggagctaacagaggagaagctccatggagagccaaaacctggcggcagcgcaaaagatg

SEQ ID NO: 243298 - DNA, 103 bp, Artificial Sequence
  Synthetic Polynucleotide
taatacgactcactataggggtctgaggtcacactgggcctcttggctctaacagaggagaagagccatgaggcccagtaacctggcggcagcgcaaaagatg

SEQ ID NO: 243299 - DNA, 103 bp, Artificial Sequence
  Synthetic Polynucleotide
taatacgactcactatagggtgtcctttgggtctgaggtcacactgggccaacagaggagaggcccaatgtgacctcagaacctggcggcagcgcaaaagatg

SEQ ID NO: 243300 - DNA, 103 bp, Artificial Sequence
  Synthetic Polynucleotide
taatacgactcactatagggtgtcctcttttgtcctttgggtctgaggtcaacagaggagagacctcatgcccaaaggaaacctggcggcagcgcaaaagatg

SEQ ID NO: 243301 - DNA, 103 bp, Artificial Sequence
  Synthetic Polynucleotide
taatacgactcactatagggcccttagacttgtcctcttttgtcctttggaacagaggagaccaaagatgaaaagaggaaacctggcggcagcgcaaaagatg

SEQ ID NO: 243302 - DNA, 103 bp, Artificial Sequence
  Synthetic Polynucleotide
taatacgactcactatagggtttccagcatcccttagacttgtcctctttaacagaggagaaaagagatgaagtctaagaacctggcggcagcgcaaaagatg

SEQ ID NO: 243303 - DNA, 103 bp, Artificial Sequence
  Synthetic Polynucleotide
taatacgactcactatagggttgctgggattttccagcatcccttagactaacagaggagaagtctaatggatgctggaaacctggcggcagcgcaaaagatg

SEQ ID NO: 243304 - DNA, 103 bp, Artificial Sequence
  Synthetic Polynucleotide
taatacgactcactatagggtcttagctccttgctgggattttccagcataacagaggagaatgctgatgaatcccagcaacctggcggcagcgcaaaagatg

SEQ ID NO: 243305 - DNA, 103 bp, Artificial Sequence
  Synthetic Polynucleotide
taatacgactcactatagggttggtttgcttggggtctagtgagttagataacagaggagaatctaaatgactagacccaacctggcggcagcgcaaaagatg

SEQ ID NO: 243306 - DNA, 103 bp, Artificial Sequence
  Synthetic Polynucleotide
taatacgactcactatagggagcttcgccttcttagctccttgctgggataacagaggagaatcccaatgaggagctaaaacctggcggcagcgcaaaagatg

SEQ ID NO: 243307 - DNA, 103 bp, Artificial Sequence
  Synthetic Polynucleotide
taatacgactcactatagggcgtgtcctgcagcttcgccttcttagctccaacagaggagaggagctatgaaggcgaagaacctggcggcagcgcaaaagatg

SEQ ID NO: 243308 - DNA, 103 bp, Artificial Sequence
  Synthetic Polynucleotide
taatacgactcactatagggacactctggccgtgtcctgcagcttcgcctaacagaggagaaggcgaatgtgcaggacaaacctggcggcagcgcaaaagatg

SEQ ID NO: 243309 - DNA, 103 bp, Artificial Sequence
  Synthetic Polynucleotide
taatacgactcactatagggcgtagtgtgaacactctggccgtgtcctgcaacagaggagagcaggaatgggccagagtaacctggcggcagcgcaaaagatg

SEQ ID NO: 243310 - DNA, 103 bp, Artificial Sequence
  Synthetic Polynucleotide
taatacgactcactatagggggccctccttcgtagtgtgaacactctggcaacagaggagagccagaatgttcacactaaacctggcggcagcgcaaaagatg

SEQ ID NO: 243311 - DNA, 103 bp, Artificial Sequence
  Synthetic Polynucleotide
taatacgactcactatagggaggacacccgggccctccttcgtagtgtgaaacagaggagatcacacatggaaggagggaacctggcggcagcgcaaaagatg

SEQ ID NO: 243312 - DNA, 103 bp, Artificial Sequence
  Synthetic Polynucleotide
taatacgactcactatagggatcgggctggttggtttgcttggggtctagaacagaggagactagacatgaagcaaaccaacctggcggcagcgcaaaagatg

SEQ ID NO: 243313 - DNA, 103 bp, Artificial Sequence
  Synthetic Polynucleotide
taatacgactcactatagggtcgccgtggcatcgggctggttggtttgctaacagaggagaagcaaaatgaccagcccgaacctggcggcagcgcaaaagatg

SEQ ID NO: 243314 - DNA, 103 bp, Artificial Sequence
  Synthetic Polynucleotide
taatacgactcactataggggaggctggcttcgccgtggcatcgggctggaacagaggagaccagccatgtgccacggcaacctggcggcagcgcaaaagatg

SEQ ID NO: 243315 - DNA, 103 bp, Artificial Sequence
  Synthetic Polynucleotide
taatacgactcactatagggagacttggaagaggctggcttcgccgtggcaacagaggagagccacgatgaagccagccaacctggcggcagcgcaaaagatg

SEQ ID NO: 243316 - DNA, 103 bp, Artificial Sequence
  Synthetic Polynucleotide
taatacgactcactatagggcatttgcgacagacttggaagaggctggctaacagaggagaagccagatgcttccaagtaacctggcggcagcgcaaaagatg

SEQ ID NO: 243317 - DNA, 103 bp, Artificial Sequence
  Synthetic Polynucleotide
taatacgactcactataggggcagagagtccatttgcgacagacttggaaaacagaggagattccaaatgtgtcgcaaaaacctggcggcagcgcaaaagatg

SEQ ID NO: 243318 - DNA, 103 bp, Artificial Sequence
  Synthetic Polynucleotide
taatacgactcactatagggcgagtcgaaggcagagagtccatttgcgacaacagaggagagtcgcaatgggactctctaacctggcggcagcgcaaaagatg

SEQ ID NO: 243319 - DNA, 103 bp, Artificial Sequence
  Synthetic Polynucleotide
taatacgactcactataggggctgaagcttcgagtcgaaggcagagagtcaacagaggagagactctatgccttcgactaacctggcggcagcgcaaaagatg

SEQ ID NO: 243320 - DNA, 103 bp, Artificial Sequence
  Synthetic Polynucleotide
taatacgactcactatagggctggggatgtaatgtggcttttttggcttcaacagaggagagaagccatgaaagccacaaacctggcggcagcgcaaaagatg

SEQ ID NO: 243321 - DNA, 103 bp, Artificial Sequence
  Synthetic Polynucleotide
taatacgactcactataggggcagagctgtgctgaagcttcgagtcgaagaacagaggagacttcgaatggaagcttcaaacctggcggcagcgcaaaagatg

SEQ ID NO: 243322 - DNA, 103 bp, Artificial Sequence
  Synthetic Polynucleotide
taatacgactcactataggggtcttccctggcagagctgtgctgaagcttaacagaggagaaagcttatgcacagctctaacctggcggcagcgcaaaagatg

SEQ ID NO: 243323 - DNA, 103 bp, Artificial Sequence
  Synthetic Polynucleotide
taatacgactcactatagggtttccttgatgtcttccctggcagagctgtaacagaggagaacagctatgccagggaagaacctggcggcagcgcaaaagatg

SEQ ID NO: 243324 - DNA, 103 bp, Artificial Sequence
  Synthetic Polynucleotide
taatacgactcactatagggagctccaggttttccttgatgtcttccctgaacagaggagacagggaatgcatcaaggaaacctggcggcagcgcaaaagatg

SEQ ID NO: 243325 - DNA, 103 bp, Artificial Sequence
  Synthetic Polynucleotide
taatacgactcactatagggccgggcttgcagctccaggttttccttgataacagaggagaatcaagatgaacctggagaacctggcggcagcgcaaaagatg

SEQ ID NO: 243326 - DNA, 103 bp, Artificial Sequence
  Synthetic Polynucleotide
taatacgactcactatagggtgtgggttccccgggcttgcagctccaggtaacagaggagaacctggatgtgcaagcccaacctggcggcagcgcaaaagatg

SEQ ID NO: 243327 - DNA, 103 bp, Artificial Sequence
  Synthetic Polynucleotide
taatacgactcactatagggcccaggcacctgtgggttccccgggcttgcaacagaggagagcaagcatggggaacccaaacctggcggcagcgcaaaagatg

SEQ ID NO: 243328 - DNA, 103 bp, Artificial Sequence
  Synthetic Polynucleotide
taatacgactcactatagggtggcttctgtcccaggcacctgtgggttccaacagaggagaggaaccatgaggtgcctgaacctggcggcagcgcaaaagatg

SEQ ID NO: 243329 - DNA, 103 bp, Artificial Sequence
  Synthetic Polynucleotide
taatacgactcactatagggtgtggagggctggcttctgtcccaggcaccaacagaggagaggtgccatggacagaagcaacctggcggcagcgcaaaagatg

SEQ ID NO: 243330 - DNA, 103 bp, Artificial Sequence
  Synthetic Polynucleotide
taatacgactcactatagggggtgatgccctgtggagggctggcttctgtaacagaggagaacagaaatgagccctccaaacctggcggcagcgcaaaagatg

SEQ ID NO: 243331 - DNA, 103 bp, Artificial Sequence
  Synthetic Polynucleotide
taatacgactcactatagggtcctggaggcctggggatgtaatgtggcttaacagaggagaaagccaatgtacatccccaacctggcggcagcgcaaaagatg

SEQ ID NO: 243332 - DNA, 103 bp, Artificial Sequence
  Synthetic Polynucleotide
taatacgactcactataggggctcttgcagggtgatgccctgtggagggcaacagaggagagccctcatgagggcatcaaacctggcggcagcgcaaaagatg

SEQ ID NO: 243333 - DNA, 103 bp, Artificial Sequence
  Synthetic Polynucleotide
taatacgactcactatagggccggagctgggctcttgcagggtgatgcccaacagaggagagggcatatgcctgcaagaaacctggcggcagcgcaaaagatg

SEQ ID NO: 243334 - DNA, 103 bp, Artificial Sequence
  Synthetic Polynucleotide
taatacgactcactatagggagggcggcttccggagctgggctcttgcagaacagaggagactgcaaatgcccagctccaacctggcggcagcgcaaaagatg

SEQ ID NO: 243335 - DNA, 103 bp, Artificial Sequence
  Synthetic Polynucleotide
taatacgactcactatagggctgggcaccgagggcggcttccggagctggaacagaggagaccagctatggaagccgccaacctggcggcagcgcaaaagatg

SEQ ID NO: 243336 - DNA, 103 bp, Artificial Sequence
  Synthetic Polynucleotide
taatacgactcactatagggccagagcaggctgggcaccgagggcggcttaacagaggagaaagccgatgtcggtgcccaacctggcggcagcgcaaaagatg

SEQ ID NO: 243337 - DNA, 103 bp, Artificial Sequence
  Synthetic Polynucleotide
taatacgactcactataggggctgcgccttccagagcaggctgggcaccgaacagaggagacggtgcatggcctgctctaacctggcggcagcgcaaaagatg

SEQ ID NO: 243338 - DNA, 103 bp, Artificial Sequence
  Synthetic Polynucleotide
taatacgactcactatagggagaaggccgagctgcgccttccagagcaggaacagaggagacctgctatggaaggcgcaaacctggcggcagcgcaaaagatg

SEQ ID NO: 243339 - DNA, 103 bp, Artificial Sequence
  Synthetic Polynucleotide
taatacgactcactataggggaacaaatgcagaaggccgagctgcgccttaacagaggagaaaggcgatgctcggccttaacctggcggcagcgcaaaagatg

SEQ ID NO: 243340 - DNA, 103 bp, Artificial Sequence
  Synthetic Polynucleotide
taatacgactcactatagggtcgccgactggaacaaatgcagaaggccgaaacagaggagatcggccatgtgcatttgtaacctggcggcagcgcaaaagatg

SEQ ID NO: 243341 - DNA, 103 bp, Artificial Sequence
  Synthetic Polynucleotide
taatacgactcactataggggagtctgtgctcgccgactggaacaaatgcaacagaggagagcatttatgccagtcggcaacctggcggcagcgcaaaagatg

SEQ ID NO: 243342 - DNA, 103 bp, Artificial Sequence
  Synthetic Polynucleotide
taatacgactcactatagggtgaagggctttcctggaggcctggggatgtaacagaggagaacatccatgggcctccagaacctggcggcagcgcaaaagatg

SEQ ID NO: 243343 - DNA, 103 bp, Artificial Sequence
  Synthetic Polynucleotide
taatacgactcactatagggctggccccttgagtctgtgctcgccgactgaacagaggagacagtcgatgagcacagacaacctggcggcagcgcaaaagatg

SEQ ID NO: 243344 - DNA, 103 bp, Artificial Sequence
  Synthetic Polynucleotide
taatacgactcactatagggtcggcgttgtctggccccttgagtctgtgcaacagaggagagcacagatgcaaggggccaacctggcggcagcgcaaaagatg

SEQ ID NO: 243345 - DNA, 103 bp, Artificial Sequence
  Synthetic Polynucleotide
taatacgactcactatagggctcgggcgcctcggcgttgtctggccccttaacagaggagaaaggggatggacaacgccaacctggcggcagcgcaaaagatg

SEQ ID NO: 243346 - DNA, 103 bp, Artificial Sequence
  Synthetic Polynucleotide
taatacgactcactatagggaagccagtgtctcgggcgcctcggcgttgtaacagaggagaacaacgatgaggcgcccgaacctggcggcagcgcaaaagatg

SEQ ID NO: 243347 - DNA, 103 bp, Artificial Sequence
  Synthetic Polynucleotide
taatacgactcactataggggggttgtgtaaagccagtgtctcgggcgccaacagaggagaggcgccatggacactggcaacctggcggcagcgcaaaagatg

SEQ ID NO: 243348 - DNA, 103 bp, Artificial Sequence
  Synthetic Polynucleotide
taatacgactcactatagggcttggcagtggggttgtgtaaagccagtgtaacagaggagaacactgatgttacacaacaacctggcggcagcgcaaaagatg

SEQ ID NO: 243349 - DNA, 103 bp, Artificial Sequence
  Synthetic Polynucleotide
taatacgactcactatagggaagacacggccttggcagtggggttgtgtaaacagaggagatacacaatgccactgccaaacctggcggcagcgcaaaagatg

SEQ ID NO: 243350 - DNA, 103 bp, Artificial Sequence
  Synthetic Polynucleotide
taatacgactcactatagggttggtgtggaaagacacggccttggcagtgaacagaggagacactgcatgggccgtgtcaacctggcggcagcgcaaaagatg

SEQ ID NO: 243351 - DNA, 103 bp, Artificial Sequence
  Synthetic Polynucleotide
taatacgactcactataggggaaggccgacttggtgtggaaagacacggcaacagaggagagccgtgatgttccacaccaacctggcggcagcgcaaaagatg

SEQ ID NO: 243352 - DNA, 103 bp, Artificial Sequence
  Synthetic Polynucleotide
taatacgactcactatagggcaggagtgtggaaggccgacttggtgtggaaacagaggagatccacaatgagtcggcctaacctggcggcagcgcaaaagatg

SEQ ID NO: 243353 - DNA, 103 bp, Artificial Sequence
  Synthetic Polynucleotide
taatacgactcactatagggcatttatacttgaagggctttcctggaggcaacagaggagagcctccatgaaagcccttaacctggcggcagcgcaaaagatg

SEQ ID NO: 243354 - DNA, 103 bp, Artificial Sequence
  Synthetic Polynucleotide
taatacgactcactatagggcaggggtagccaggagtgtggaaggccgacaacagaggagagtcggcatgccacactccaacctggcggcagcgcaaaagatg

SEQ ID NO: 243355 - DNA, 103 bp, Artificial Sequence
  Synthetic Polynucleotide
taatacgactcactataggggccggctttccaggggtagccaggagtgtgaacagaggagacacactatgggctaccccaacctggcggcagcgcaaaagatg

SEQ ID NO: 243356 - DNA, 103 bp, Artificial Sequence
  Synthetic Polynucleotide
taatacgactcactatagggggaaaggtgagccggctttccaggggtagcaacagaggagagctaccatgggaaagccgaacctggcggcagcgcaaaagatg

SEQ ID NO: 243357 - DNA, 103 bp, Artificial Sequence
  Synthetic Polynucleotide
taatacgactcactatagggtctggtggaaggaaaggtgagccggctttcaacagaggagagaaagcatgctcacctttaacctggcggcagcgcaaaagatg

SEQ ID NO: 243358 - DNA, 103 bp, Artificial Sequence
  Synthetic Polynucleotide
taatacgactcactatagggatgtggaaactctggtggaaggaaaggtgaaacagaggagatcacctatgcttccaccaaacctggcggcagcgcaaaagatg

SEQ ID NO: 243359 - DNA, 103 bp, Artificial Sequence
  Synthetic Polynucleotide
taatacgactcactatagggatgagattttatgtggaaactctggtggaaaacagaggagattccacatgagtttccacaacctggcggcagcgcaaaagatg

SEQ ID NO: 243360 - DNA, 103 bp, Artificial Sequence
  Synthetic Polynucleotide
taatacgactcactatagggccctttgtagatgagattttatgtggaaacaacagaggagagtttccatgtaaaatctcaacctggcggcagcgcaaaagatg

SEQ ID NO: 243361 - DNA, 103 bp, Artificial Sequence
  Synthetic Polynucleotide
taatacgactcactatagggggccccaagcccctttgtagatgagattttaacagaggagaaaaatcatgtctacaaagaacctggcggcagcgcaaaagatg

SEQ ID NO: 243362 - DNA, 103 bp, Artificial Sequence
  Synthetic Polynucleotide
taatacgactcactatagggaaggggaaatggccccaagcccctttgtagaacagaggagactacaaatgggcttggggaacctggcggcagcgcaaaagatg

SEQ ID NO: 243363 - DNA, 103 bp, Artificial Sequence
  Synthetic Polynucleotide
taatacgactcactataggggggtgcatgtaaggggaaatggccccaagcaacagaggagagcttggatgcatttccccaacctggcggcagcgcaaaagatg

SEQ ID NO: 243364 - DNA, 103 bp, Artificial Sequence
  Synthetic Polynucleotide
taatacgactcactatagggacattggaaacatttatacttgaagggcttaacagaggagaaagcccatgaagtataaaaacctggcggcagcgcaaaagatg

SEQ ID NO: 243365 - DNA, 103 bp, Artificial Sequence
  Synthetic Polynucleotide
taatacgactcactatagggtgggattgtggggtgcatgtaaggggaaataacagaggagaatttccatgtacatgcacaacctggcggcagcgcaaaagatg

SEQ ID NO: 243366 - DNA, 103 bp, Artificial Sequence
  Synthetic Polynucleotide
taatacgactcactataggggcgggtactctgggattgtggggtgcatgtaacagaggagaacatgcatgccacaatccaacctggcggcagcgcaaaagatg

SEQ ID NO: 243367 - DNA, 103 bp, Artificial Sequence
  Synthetic Polynucleotide
taatacgactcactatagggtaaaagtgaggcgggtactctgggattgtgaacagaggagacacaatatgagagtacccaacctggcggcagcgcaaaagatg

SEQ ID NO: 243368 - DNA, 103 bp, Artificial Sequence
  Synthetic Polynucleotide
taatacgactcactataggggtgctctgtgtaaaagtgaggcgggtactcaacagaggagagagtacatgcctcactttaacctggcggcagcgcaaaagatg

SEQ ID NO: 243369 - DNA, 103 bp, Artificial Sequence
  Synthetic Polynucleotide
taatacgactcactatagggtggccagcccgtgctctgtgtaaaagtgagaacagaggagactcactatgacacagagcaacctggcggcagcgcaaaagatg

SEQ ID NO: 243370 - DNA, 103 bp, Artificial Sequence
  Synthetic Polynucleotide
taatacgactcactataggggagtagatggtggccagcccgtgctctgtgaacagaggagacacagaatgcgggctggcaacctggcggcagcgcaaaagatg

SEQ ID NO: 243371 - DNA, 103 bp, Artificial Sequence
  Synthetic Polynucleotide
taatacgactcactatagggcaggtaaggcgagtagatggtggccagcccaacagaggagagggctgatgaccatctacaacctggcggcagcgcaaaagatg

SEQ ID NO: 243372 - DNA, 103 bp, Artificial Sequence
  Synthetic Polynucleotide
taatacgactcactatagggtcccagccagcaggtaaggcgagtagatggaacagaggagaccatctatgcgccttaccaacctggcggcagcgcaaaagatg

SEQ ID NO: 243373 - DNA, 103 bp, Artificial Sequence
  Synthetic Polynucleotide
taatacgactcactatagggtcaggcgagctcccagccagcaggtaaggcaacagaggagagccttaatggctggctggaacctggcggcagcgcaaaagatg

SEQ ID NO: 243374 - DNA, 103 bp, Artificial Sequence
  Synthetic Polynucleotide
taatacgactcactatagggtgcgtcacactcaggcgagctcccagccagaacagaggagactggctatgagctcgcctaacctggcggcagcgcaaaagatg

SEQ ID NO: 243375 - DNA, 103 bp, Artificial Sequence
  Synthetic Polynucleotide
taatacgactcactatagggaagtaaagggacattggaaacatttatactaacagaggagaagtataatggtttccaataacctggcggcagcgcaaaagatg

SEQ ID NO: 243376 - DNA, 103 bp, Artificial Sequence
  Synthetic Polynucleotide
taatacgactcactatagggacagcaggggtgcgtcacactcaggcgagcaacagaggagagctcgcatgagtgtgacgaacctggcggcagcgcaaaagatg

SEQ ID NO: 243377 - DNA, 103 bp, Artificial Sequence
  Synthetic Polynucleotide
taatacgactcactatagggccgtagactgacagcaggggtgcgtcacacaacagaggagagtgtgaatgacccctgctaacctggcggcagcgcaaaagatg

SEQ ID NO: 243378 - DNA, 103 bp, Artificial Sequence
  Synthetic Polynucleotide
taatacgactcactataggggtcttgggttccgtagactgacagcaggggaacagaggagacccctgatgtcagtctacaacctggcggcagcgcaaaagatg

SEQ ID NO: 243379 - DNA, 103 bp, Artificial Sequence
  Synthetic Polynucleotide
taatacgactcactatagggagtgtctcgggtcttgggttccgtagactgaacagaggagacagtctatggaacccaagaacctggcggcagcgcaaaagatg

SEQ ID NO: 243380 - DNA, 103 bp, Artificial Sequence
  Synthetic Polynucleotide
taatacgactcactatagggtgaggcaggaagtgtctcgggtcttgggttaacagaggagaaacccaatgcccgagacaaacctggcggcagcgcaaaagatg

SEQ ID NO: 243381 - DNA, 103 bp, Artificial Sequence
  Synthetic Polynucleotide
taatacgactcactatagggcggccccgggtgaggcaggaagtgtctcggaacagaggagaccgagaatgttcctgcctaacctggcggcagcgcaaaagatg

SEQ ID NO: 243382 - DNA, 103 bp, Artificial Sequence
  Synthetic Polynucleotide
taatacgactcactataggggcttagggatcggccccgggtgaggcaggaaacagaggagatcctgcatgacccggggcaacctggcggcagcgcaaaagatg

SEQ ID NO: 243383 - DNA, 103 bp, Artificial Sequence
  Synthetic Polynucleotide
taatacgactcactatagggggagccaggtgcttagggatcggccccgggaacagaggagacccgggatggatccctaaaacctggcggcagcgcaaaagatg

SEQ ID NO: 243384 - DNA, 103 bp, Artificial Sequence
  Synthetic Polynucleotide
taatacgactcactatagggggctggagatggagccaggtgcttagggataacagaggagaatccctatgcacctggctaacctggcggcagcgcaaaagatg

SEQ ID NO: 243385 - DNA, 103 bp, Artificial Sequence
  Synthetic Polynucleotide
taatacgactcactataggggatcgtatgtggctggagatggagccaggtaacagaggagaacctggatgcatctccagaacctggcggcagcgcaaaagatg

SEQ ID NO: 243386 - DNA, 103 bp, Artificial Sequence
  Synthetic Polynucleotide
taatacgactcactatagggttctcattgcaagtaaagggacattggaaaaacagaggagatttccaatgtccctttacaacctggcggcagcgcaaaagatg

SEQ ID NO: 243387 - DNA, 103 bp, Artificial Sequence
  Synthetic Polynucleotide
taatacgactcactatagggaacctgtagtgatcgtatgtggctggagataacagaggagaatctccatgcacatacgaaacctggcggcagcgcaaaagatg

SEQ ID NO: 243388 - DNA, 103 bp, Artificial Sequence
  Synthetic Polynucleotide
taatacgactcactatagggttgctggaaaaacctgtagtgatcgtatgtaacagaggagaacatacatgcactacaggaacctggcggcagcgcaaaagatg

SEQ ID NO: 243389 - DNA, 103 bp, Artificial Sequence
  Synthetic Polynucleotide
taatacgactcactatagggtagagggatattgctggaaaaacctgtagtaacagaggagaactacaatgttttccagcaacctggcggcagcgcaaaagatg

SEQ ID NO: 243390 - DNA, 103 bp, Artificial Sequence
  Synthetic Polynucleotide
taatacgactcactatagggatcggcaggttagagggatattgctggaaaaacagaggagatttccaatgatatccctcaacctggcggcagcgcaaaagatg

SEQ ID NO: 243391 - DNA, 103 bp, Artificial Sequence
  Synthetic Polynucleotide
taatacgactcactatagggtccgtaaggaatcggcaggttagagggataaacagaggagatatcccatgaacctgccgaacctggcggcagcgcaaaagatg

SEQ ID NO: 243392 - DNA, 103 bp, Artificial Sequence
  Synthetic Polynucleotide
taatacgactcactataggggcctgtaaaatccgtaaggaatcggcaggtaacagaggagaacctgcatgttccttacgaacctggcggcagcgcaaaagatg

SEQ ID NO: 243393 - DNA, 103 bp, Artificial Sequence
  Synthetic Polynucleotide
taatacgactcactataggggcagactctggcctgtaaaatccgtaaggaaacagaggagatccttaatgattttacagaacctggcggcagcgcaaaagatg

SEQ ID NO: 243394 - DNA, 103 bp, Artificial Sequence
  Synthetic Polynucleotide
taatacgactcactatagggggaggaaaatgcagactctggcctgtaaaaaacagaggagattttacatgccagagtctaacctggcggcagcgcaaaagatg

SEQ ID NO: 243395 - DNA, 103 bp, Artificial Sequence
  Synthetic Polynucleotide
taatacgactcactatagggtgagaccataggaggaaaatgcagactctgaacagaggagacagagtatgcattttcctaacctggcggcagcgcaaaagatg

SEQ ID NO: 243396 - DNA, 103 bp, Artificial Sequence
  Synthetic Polynucleotide
taatacgactcactatagggggtgggagtctgagaccataggaggaaaataacagaggagaattttcatgctatggtctaacctggcggcagcgcaaaagatg

SEQ ID NO: 243397 - DNA, 103 bp, Artificial Sequence
  Synthetic Polynucleotide
taatacgactcactatagggatttggatttgtctgtttccgacgggacataacagaggagaatgtccatgcggaaacagaacctggcggcagcgcaaaagatg

SEQ ID NO: 243398 - DNA, 103 bp, Artificial Sequence
  Synthetic Polynucleotide
taatacgactcactatagggactgccaaggtctccaggaaaatcagttttaacagaggagaaaaactatgtttcctggaaacctggcggcagcgcaaaagatg

SEQ ID NO: 243399 - DNA, 103 bp, Artificial Sequence
  Synthetic Polynucleotide
taatacgactcactatagggctgccgcttttccggggtttcattggcccgaacagaggagacgggccatggaaaccccgaacctggcggcagcgcaaaagatg

SEQ ID NO: 243400 - DNA, 103 bp, Artificial Sequence
  Synthetic Polynucleotide
taatacgactcactatagggtgagccgggcctgccgcttttccggggtttaacagaggagaaaacccatgaaaagcggcaacctggcggcagcgcaaaagatg

SEQ ID NO: 243401 - DNA, 103 bp, Artificial Sequence
  Synthetic Polynucleotide
taatacgactcactatagggcgctctcggatgagccgggcctgccgctttaacagaggagaaaagcgatgggcccggctaacctggcggcagcgcaaaagatg

SEQ ID NO: 243402 - DNA, 103 bp, Artificial Sequence
  Synthetic Polynucleotide
taatacgactcactatagggcttggcctctcgctctcggatgagccgggcaacagaggagagcccggatgatccgagagaacctggcggcagcgcaaaagatg

SEQ ID NO: 243403 - DNA, 103 bp, Artificial Sequence
  Synthetic Polynucleotide
taatacgactcactatagggtcttgagccgcttggcctctcgctctcggaaacagaggagatccgagatggagaggccaaacctggcggcagcgcaaaagatg

SEQ ID NO: 243404 - DNA, 103 bp, Artificial Sequence
  Synthetic Polynucleotide
taatacgactcactatagggtccagcctcctcttgagccgcttggcctctaacagaggagaagaggcatggcggctcaaaacctggcggcagcgcaaaagatg

SEQ ID NO: 243405 - DNA, 103 bp, Artificial Sequence
  Synthetic Polynucleotide
taatacgactcactataggggtccattttctccagcctcctcttgagccgaacagaggagacggctcatgaggaggctgaacctggcggcagcgcaaaagatg

SEQ ID NO: 243406 - DNA, 103 bp, Artificial Sequence
  Synthetic Polynucleotide
taatacgactcactataggggcaacatcatgtccattttctccagcctccaacagaggagaggaggcatgagaaaatggaacctggcggcagcgcaaaagatg

SEQ ID NO: 243407 - DNA, 103 bp, Artificial Sequence
  Synthetic Polynucleotide
taatacgactcactatagggaactgagctcgcaacatcatgtccattttcaacagaggagagaaaatatgcatgatgttaacctggcggcagcgcaaaagatg

SEQ ID NO: 243408 - DNA, 103 bp, Artificial Sequence
  Synthetic Polynucleotide
taatacgactcactataggggtcctggccaaactgagctcgcaacatcataacagaggagaatgatgatgcgagctcagaacctggcggcagcgcaaaagatg

SEQ ID NO: 243409 - DNA, 103 bp, Artificial Sequence
  Synthetic Polynucleotide
taatacgactcactatagggcttgtcgctgactgccaaggtctccaggaaaacagaggagattcctgatgaccttggcaaacctggcggcagcgcaaaagatg

SEQ ID NO: 243410 - DNA, 103 bp, Artificial Sequence
  Synthetic Polynucleotide
taatacgactcactatagggtggcagaagggtcctggccaaactgagctcaacagaggagagagctcatgttggccaggaacctggcggcagcgcaaaagatg

SEQ ID NO: 243411 - DNA, 103 bp, Artificial Sequence
  Synthetic Polynucleotide
taatacgactcactatagggaaggctgccatggcagaagggtcctggccaaacagaggagatggccaatgcccttctgcaacctggcggcagcgcaaaagatg

SEQ ID NO: 243412 - DNA, 103 bp, Artificial Sequence
  Synthetic Polynucleotide
taatacgactcactatagggttcagctgctaaggctgccatggcagaaggaacagaggagaccttctatgatggcagccaacctggcggcagcgcaaaagatg

SEQ ID NO: 243413 - DNA, 103 bp, Artificial Sequence
  Synthetic Polynucleotide
taatacgactcactatagggagaagttcatttcagctgctaaggctgccaaacagaggagatggcagatgtagcagctgaacctggcggcagcgcaaaagatg

SEQ ID NO: 243414 - DNA, 103 bp, Artificial Sequence
  Synthetic Polynucleotide
taatacgactcactatagggggcagctggaagaagttcatttcagctgctaacagaggagaagcagcatgaatgaacttaacctggcggcagcgcaaaagatg

SEQ ID NO: 243415 - DNA, 103 bp, Artificial Sequence
  Synthetic Polynucleotide
taatacgactcactatagggcccacttacaggcagctggaagaagttcataacagaggagaatgaacatgttccagctgaacctggcggcagcgcaaaagatg

SEQ ID NO: 243416 - DNA, 103 bp, Artificial Sequence
  Synthetic Polynucleotide
taatacgactcactatagggccaactccaccccacttacaggcagctggaaacagaggagatccagcatgctgtaagtgaacctggcggcagcgcaaaagatg

SEQ ID NO: 243417 - DNA, 103 bp, Artificial Sequence
  Synthetic Polynucleotide
taatacgactcactatagggagctggctgtccaactccaccccacttacaaacagaggagatgtaagatgggtggagttaacctggcggcagcgcaaaagatg

SEQ ID NO: 243418 - DNA, 103 bp, Artificial Sequence
  Synthetic Polynucleotide
taatacgactcactatagggcttgcccagaagctggctgtccaactccacaacagaggagagtggagatggacagccagaacctggcggcagcgcaaaagatg

SEQ ID NO: 243419 - DNA, 103 bp, Artificial Sequence
  Synthetic Polynucleotide
taatacgactcactatagggcaaaggccatcttgcccagaagctggctgtaacagaggagaacagccatgttctgggcaaacctggcggcagcgcaaaagatg

SEQ ID NO: 243420 - DNA, 103 bp, Artificial Sequence
  Synthetic Polynucleotide
taatacgactcactatagggtgttggatagcttgtcgctgactgccaaggaacagaggagaccttggatgtcagcgacaaacctggcggcagcgcaaaagatg

SEQ ID NO: 243421 - DNA, 103 bp, Artificial Sequence
  Synthetic Polynucleotide
taatacgactcactatagggttctgctcttcaaaggccatcttgcccagaaacagaggagatctgggatggatggccttaacctggcggcagcgcaaaagatg

SEQ ID NO: 243422 - DNA, 103 bp, Artificial Sequence
  Synthetic Polynucleotide
taatacgactcactatagggagagctgctgttctgctcttcaaaggccataacagaggagaatggccatggaagagcagaacctggcggcagcgcaaaagatg

SEQ ID NO: 243423 - DNA, 103 bp, Artificial Sequence
  Synthetic Polynucleotide
taatacgactcactatagggatctcttagttgttggatagcttgtcgctgaacagaggagacagcgaatggctatccaaaacctggcggcagcgcaaaagatg

SEQ ID NO: 243424 - DNA, 103 bp, Artificial Sequence
  Synthetic Polynucleotide
taatacgactcactatagggtggagtcctgatctcttagttgttggatagaacagaggagactatccatgaactaagagaacctggcggcagcgcaaaagatg

SEQ ID NO: 243425 - DNA, 103 bp, Artificial Sequence
  Synthetic Polynucleotide
taatacgactcactatagggtcactgctactggagtcctgatctcttagtaacagaggagaactaagatgtcaggactcaacctggcggcagcgcaaaagatg

SEQ ID NO: 243426 - DNA, 103 bp, Artificial Sequence
  Synthetic Polynucleotide
taatacgactcactatagggaccctcactgtcactgctactggagtcctgaacagaggagacaggacatgagtagcagtaacctggcggcagcgcaaaagatg

SEQ ID NO: 243427 - DNA, 103 bp, Artificial Sequence
  Synthetic Polynucleotide
taatacgactcactatagggcctcttcatcaccctcactgtcactgctacaacagaggagagtagcaatgacagtgaggaacctggcggcagcgcaaaagatg

SEQ ID NO: 243428 - DNA, 103 bp, Artificial Sequence
  Synthetic Polynucleotide
taatacgactcactatagggtgtgtcgtctcctcttcatcaccctcactgaacagaggagacagtgaatgtgatgaagaaacctggcggcagcgcaaaagatg

SEQ ID NO: 243429 - DNA, 103 bp, Artificial Sequence
  Synthetic Polynucleotide
taatacgactcactataggggacttcatcttgtgtcgtctcctcttcatcaacagaggagagatgaaatggagacgacaaacctggcggcagcgcaaaagatg

SEQ ID NO: 243430 - DNA, 103 bp, Artificial Sequence
  Synthetic Polynucleotide
taatacgactcactatagggagtgaactttatttggatttgtctgtttccaacagaggagaggaaacatgcaaatccaaaacctggcggcagcgcaaaagatg

SEQ ID NO: 243431 - DNA, 103 bp, Artificial Sequence
  Synthetic Polynucleotide
taatacgactcactatagggtgtgggaagagacttcatcttgtgtcgtctaacagaggagaagacgaatgaagatgaagaacctggcggcagcgcaaaagatg

SEQ ID NO: 243432 - DNA, 103 bp, Artificial Sequence
  Synthetic Polynucleotide
taatacgactcactatagggtcctctgatgtgtgggaagagacttcatctaacagaggagaagatgaatgctcttcccaaacctggcggcagcgcaaaagatg

SEQ ID NO: 243433 - DNA, 103 bp, Artificial Sequence
  Synthetic Polynucleotide
taatacgactcactatagggccctccatcttcctctgatgtgtgggaagaaacagaggagatcttccatgacatcagagaacctggcggcagcgcaaaagatg

SEQ ID NO: 243434 - DNA, 103 bp, Artificial Sequence
  Synthetic Polynucleotide
taatacgactcactatagggctttgaccacccctccatcttcctctgatgaacagaggagacatcagatgaagatggagaacctggcggcagcgcaaaagatg

SEQ ID NO: 243435 - DNA, 103 bp, Artificial Sequence
  Synthetic Polynucleotide
taatacgactcactatagggtctttctccactttgaccacccctccatctaacagaggagaagatggatgggtggtcaaaacctggcggcagcgcaaaagatg

SEQ ID NO: 243436 - DNA, 103 bp, Artificial Sequence
  Synthetic Polynucleotide
taatacgactcactatagggattttctaactctttctccactttgaccacaacagaggagagtggtcatggtggagaaaaacctggcggcagcgcaaaagatg

SEQ ID NO: 243437 - DNA, 103 bp, Artificial Sequence
  Synthetic Polynucleotide
taatacgactcactataggggctgttctgtattttctaactctttctccaaacagaggagatggagaatgagttagaaaaacctggcggcagcgcaaaagatg

SEQ ID NO: 243438 - DNA, 103 bp, Artificial Sequence
  Synthetic Polynucleotide
taatacgactcactatagggccaccaacaggctgttctgtattttctaacaacagaggagagttagaatgtacagaacaaacctggcggcagcgcaaaagatg

SEQ ID NO: 243439 - DNA, 103 bp, Artificial Sequence
  Synthetic Polynucleotide
taatacgactcactatagggcacttcgttcccaccaacaggctgttctgtaacagaggagaacagaaatgcctgttggtaacctggcggcagcgcaaaagatg

SEQ ID NO: 243440 - DNA, 103 bp, Artificial Sequence
  Synthetic Polynucleotide
taatacgactcactatagggcgtgctctaccacttcgttcccaccaacagaacagaggagactgttgatgggaacgaagaacctggcggcagcgcaaaagatg

SEQ ID NO: 243441 - DNA, 103 bp, Artificial Sequence
  Synthetic Polynucleotide
taatacgactcactatagggacttgatcccagtgaactttatttggatttaacagaggagaaaatccatgtaaagttcaaacctggcggcagcgcaaaagatg

SEQ ID NO: 243442 - DNA, 103 bp, Artificial Sequence
  Synthetic Polynucleotide
taatacgactcactatagggcctgtgacctcgtgctctaccacttcgttcaacagaggagagaacgaatgggtagagcaaacctggcggcagcgcaaaagatg

SEQ ID NO: 243443 - DNA, 103 bp, Artificial Sequence
  Synthetic Polynucleotide
taatacgactcactatagggattcaaattccctgtgacctcgtgctctacaacagaggagagtagagatggaggtcacaaacctggcggcagcgcaaaagatg

SEQ ID NO: 243444 - DNA, 103 bp, Artificial Sequence
  Synthetic Polynucleotide
taatacgactcactatagggaggggtcagaattcaaattccctgtgacctaacagaggagaaggtcaatgggaatttgaaacctggcggcagcgcaaaagatg

SEQ ID NO: 243445 - DNA, 103 bp, Artificial Sequence
  Synthetic Polynucleotide
taatacgactcactatagggagttcaagcaaggggtcagaattcaaattcaacagaggagagaatttatgttctgacccaacctggcggcagcgcaaaagatg

SEQ ID NO: 243446 - DNA, 103 bp, Artificial Sequence
  Synthetic Polynucleotide
taatacgactcactatagggacactggcagagttcaagcaaggggtcagaaacagaggagatctgacatgttgcttgaaaacctggcggcagcgcaaaagatg

SEQ ID NO: 243447 - DNA, 103 bp, Artificial Sequence
  Synthetic Polynucleotide
taatacgactcactatagggggcagaggggacactggcagagttcaagcaaacagaggagatgcttgatgtctgccagtaacctggcggcagcgcaaaagatg

SEQ ID NO: 243448 - DNA, 103 bp, Artificial Sequence
  Synthetic Polynucleotide
taatacgactcactatagggcagtctagctggcagaggggacactggcagaacagaggagactgccaatgtcccctctgaacctggcggcagcgcaaaagatg

SEQ ID NO: 243449 - DNA, 103 bp, Artificial Sequence
  Synthetic Polynucleotide
taatacgactcactatagggccggctcccgcagtctagctggcagaggggaacagaggagacccctcatgcagctagacaacctggcggcagcgcaaaagatg

SEQ ID NO: 243450 - DNA, 103 bp, Artificial Sequence
  Synthetic Polynucleotide
taatacgactcactatagggtcaactgctcccggctcccgcagtctagctaacagaggagaagctagatggcgggagccaacctggcggcagcgcaaaagatg

SEQ ID NO: 243451 - DNA, 103 bp, Artificial Sequence
  Synthetic Polynucleotide
taatacgactcactatagggacgtgagcaatcaactgctcccggctcccgaacagaggagacgggagatgggagcagttaacctggcggcagcgcaaaagatg

SEQ ID NO: 243452 - DNA, 103 bp, Artificial Sequence
  Synthetic Polynucleotide
taatacgactcactatagggcccagcaaatacttgatcccagtgaactttaacagaggagaaaagttatgtgggatcaaaacctggcggcagcgcaaaagatg

SEQ ID NO: 243453 - DNA, 103 bp, Artificial Sequence
  Synthetic Polynucleotide
taatacgactcactataggggtgctggtacacgtgagcaatcaactgctcaacagaggagagagcagatgattgctcacaacctggcggcagcgcaaaagatg

SEQ ID NO: 243454 - DNA, 103 bp, Artificial Sequence
  Synthetic Polynucleotide
taatacgactcactatagggctgctgcagtgtgctggtacacgtgagcaaaacagaggagattgctcatgtgtaccagcaacctggcggcagcgcaaaagatg

SEQ ID NO: 243455 - DNA, 103 bp, Artificial Sequence
  Synthetic Polynucleotide
taatacgactcactataggggcgctcaccactgctgcagtgtgctggtacaacagaggagagtaccaatgcactgcagcaacctggcggcagcgcaaaagatg

SEQ ID NO: 243456 - DNA, 103 bp, Artificial Sequence
  Synthetic Polynucleotide
taatacgactcactataggggtagctcttggcgctcaccactgctgcagtaacagaggagaactgcaatggtggtgagcaacctggcggcagcgcaaaagatg

SEQ ID NO: 243457 - DNA, 103 bp, Artificial Sequence
  Synthetic Polynucleotide
taatacgactcactatagggcaggacacatgtagctcttggcgctcaccaaacagaggagatggtgaatgccaagagctaacctggcggcagcgcaaaagatg

SEQ ID NO: 243458 - DNA, 103 bp, Artificial Sequence
  Synthetic Polynucleotide
taatacgactcactatagggcggccacagacaggacacatgtagctcttgaacagaggagacaagagatgcatgtgtccaacctggcggcagcgcaaaagatg

SEQ ID NO: 243459 - DNA, 103 bp, Artificial Sequence
  Synthetic Polynucleotide
taatacgactcactataggggctaagggcccggccacagacaggacacataacagaggagaatgtgtatggtctgtggcaacctggcggcagcgcaaaagatg

SEQ ID NO: 243460 - DNA, 103 bp, Artificial Sequence
  Synthetic Polynucleotide
taatacgactcactatagggaccccggggagctaagggcccggccacagaaacagaggagatctgtgatggggcccttaaacctggcggcagcgcaaaagatg

SEQ ID NO: 243461 - DNA, 103 bp, Artificial Sequence
  Synthetic Polynucleotide
taatacgactcactatagggcgacccaatgaccccggggagctaagggccaacagaggagaggccctatgctccccgggaacctggcggcagcgcaaaagatg

SEQ ID NO: 243462 - DNA, 103 bp, Artificial Sequence
  Synthetic Polynucleotide
taatacgactcactatagggtaagaggtggcgacccaatgaccccggggaaacagaggagatccccgatgtcattgggtaacctggcggcagcgcaaaagatg

SEQ ID NO: 243463 - DNA, 103 bp, Artificial Sequence
  Synthetic Polynucleotide
taatacgactcactataggggctcttctagcccagcaaatacttgatcccaacagaggagagggatcatgtatttgctgaacctggcggcagcgcaaaagatg

SEQ ID NO: 243464 - DNA, 103 bp, Artificial Sequence
  Synthetic Polynucleotide
taatacgactcactatagggccgagtggattaagaggtggcgacccaatgaacagaggagacattggatggccacctctaacctggcggcagcgcaaaagatg

SEQ ID NO: 243465 - DNA, 103 bp, Artificial Sequence
  Synthetic Polynucleotide
taatacgactcactatagggcgctggtcctccgagtggattaagaggtggaacagaggagaccacctatgaatccactcaacctggcggcagcgcaaaagatg

SEQ ID NO: 243466 - DNA, 103 bp, Artificial Sequence
  Synthetic Polynucleotide
taatacgactcactatagggacagttagatcgctggtcctccgagtggataacagaggagaatccacatggaggaccagaacctggcggcagcgcaaaagatg

SEQ ID NO: 243467 - DNA, 103 bp, Artificial Sequence
  Synthetic Polynucleotide
taatacgactcactatagggcacacacagcacagttagatcgctggtcctaacagaggagaaggaccatggatctaactaacctggcggcagcgcaaaagatg

SEQ ID NO: 243468 - DNA, 103 bp, Artificial Sequence
  Synthetic Polynucleotide
taatacgactcactatagggaaccgggctccacacacagcacagttagataacagaggagaatctaaatgtgctgtgtgaacctggcggcagcgcaaaagatg

SEQ ID NO: 243469 - DNA, 103 bp, Artificial Sequence
  Synthetic Polynucleotide
taatacgactcactatagggatggctggtgaaccgggctccacacacagcaacagaggagagctgtgatgggagcccggaacctggcggcagcgcaaaagatg

SEQ ID NO: 243470 - DNA, 103 bp, Artificial Sequence
  Synthetic Polynucleotide
taatacgactcactatagggtaaaagtggcatggctggtgaaccgggctcaacagaggagagagcccatgtcaccagccaacctggcggcagcgcaaaagatg

SEQ ID NO: 243471 - DNA, 103 bp, Artificial Sequence
  Synthetic Polynucleotide
taatacgactcactatagggttctcactgttaaaagtggcatggctggtgaacagaggagacaccagatgtgccactttaacctggcggcagcgcaaaagatg

SEQ ID NO: 243472 - DNA, 103 bp, Artificial Sequence
  Synthetic Polynucleotide
taatacgactcactatagggttcaggaagtttctcactgttaaaagtggcaacagaggagagccactatgaacagtgagaacctggcggcagcgcaaaagatg

SEQ ID NO: 243473 - DNA, 103 bp, Artificial Sequence
  Synthetic Polynucleotide
taatacgactcactatagggtatttagtacttcaggaagtttctcactgtaacagaggagaacagtgatgaacttcctgaacctggcggcagcgcaaaagatg

SEQ ID NO: 243474 - DNA, 103 bp, Artificial Sequence
  Synthetic Polynucleotide
taatacgactcactatagggtggcgggcttgctcttctagcccagcaaataacagaggagaatttgcatggctagaagaaacctggcggcagcgcaaaagatg

SEQ ID NO: 243475 - DNA, 103 bp, Artificial Sequence
  Synthetic Polynucleotide
taatacgactcactatagggagggattccatatttagtacttcaggaagtaacagaggagaacttccatgagtactaaaaacctggcggcagcgcaaaagatg

SEQ ID NO: 243476 - DNA, 103 bp, Artificial Sequence
  Synthetic Polynucleotide
taatacgactcactataggggactgtgggtagggattccatatttagtacaacagaggagagtactaatgatggaatccaacctggcggcagcgcaaaagatg

SEQ ID NO: 243477 - DNA, 103 bp, Artificial Sequence
  Synthetic Polynucleotide
taatacgactcactatagggcctcattgtggactgtgggtagggattccaaacagaggagatggaatatgtacccacagaacctggcggcagcgcaaaagatg

SEQ ID NO: 243478 - DNA, 103 bp, Artificial Sequence
  Synthetic Polynucleotide
taatacgactcactatagggctggagggaccctcattgtggactgtgggtaacagaggagaacccacatgccacaatgaaacctggcggcagcgcaaaagatg

SEQ ID NO: 243479 - DNA, 103 bp, Artificial Sequence
  Synthetic Polynucleotide
taatacgactcactatagggcccctcagcactggagggaccctcattgtgaacagaggagacacaatatgggtccctccaacctggcggcagcgcaaaagatg

SEQ ID NO: 243480 - DNA, 103 bp, Artificial Sequence
  Synthetic Polynucleotide
taatacgactcactatagggcaatatccttcccctcagcactggagggacaacagaggagagtccctatggtgctgaggaacctggcggcagcgcaaaagatg

SEQ ID NO: 243481 - DNA, 103 bp, Artificial Sequence
  Synthetic Polynucleotide
taatacgactcactatagggggactaaaggcaatatccttcccctcagcaaacagaggagatgctgaatggaaggatataacctggcggcagcgcaaaagatg

SEQ ID NO: 243482 - DNA, 103 bp, Artificial Sequence
  Synthetic Polynucleotide
taatacgactcactataggggtacactggaggactaaaggcaatatccttaacagaggagaaaggatatggcctttagtaacctggcggcagcgcaaaagatg

SEQ ID NO: 243483 - DNA, 103 bp, Artificial Sequence
  Synthetic Polynucleotide
taatacgactcactatagggttccagcagggtacactggaggactaaaggaacagaggagacctttaatgctccagtgtaacctggcggcagcgcaaaagatg

SEQ ID NO: 243484 - DNA, 103 bp, Artificial Sequence
  Synthetic Polynucleotide
taatacgactcactatagggacaagcagaattccagcagggtacactggaaacagaggagatccagtatgccctgctggaacctggcggcagcgcaaaagatg

SEQ ID NO: 243485 - DNA, 103 bp, Artificial Sequence
  Synthetic Polynucleotide
taatacgactcactatagggcatcatcgcctggcgggcttgctcttctagaacagaggagactagaaatgcaagcccgcaacctggcggcagcgcaaaagatg

SEQ ID NO: 243486 - DNA, 103 bp, Artificial Sequence
  Synthetic Polynucleotide
taatacgactcactataggggttgttgcacacaagcagaattccagcaggaacagaggagacctgctatgattctgcttaacctggcggcagcgcaaaagatg

SEQ ID NO: 243487 - DNA, 103 bp, Artificial Sequence
  Synthetic Polynucleotide
taatacgactcactatagggaggcagcacagttgttgcacacaagcagaaaacagaggagattctgcatgtgtgcaacaaacctggcggcagcgcaaaagatg

SEQ ID NO: 243488 - DNA, 103 bp, Artificial Sequence
  Synthetic Polynucleotide
taatacgactcactatagggagtttacggtaggcagcacagttgttgcacaacagaggagagtgcaaatgctgtgctgcaacctggcggcagcgcaaaagatg

SEQ ID NO: 243489 - DNA, 103 bp, Artificial Sequence
  Synthetic Polynucleotide
taatacgactcactatagggggcttccagcagtttacggtaggcagcacaaacagaggagatgtgctatgtaccgtaaaaacctggcggcagcgcaaaagatg

SEQ ID NO: 243490 - DNA, 103 bp, Artificial Sequence
  Synthetic Polynucleotide
taatacgactcactatagggtgggagtctgggcttccagcagtttacggtaacagaggagaaccgtaatgtgctggaagaacctggcggcagcgcaaaagatg

SEQ ID NO: 243491 - DNA, 103 bp, Artificial Sequence
  Synthetic Polynucleotide
taatacgactcactatagggttgcgtacactgggagtctgggcttccagcaacagaggagagctggaatgccagactccaacctggcggcagcgcaaaagatg

SEQ ID NO: 243492 - DNA, 103 bp, Artificial Sequence
  Synthetic Polynucleotide
taatacgactcactatagggtagagcccacttgcgtacactgggagtctgaacagaggagacagactatgagtgtacgcaacctggcggcagcgcaaaagatg

SEQ ID NO: 243493 - DNA, 103 bp, Artificial Sequence
  Synthetic Polynucleotide
taatacgactcactatagggtctgtcgacgtagagcccacttgcgtacacaacagaggagagtgtacatgagtgggctcaacctggcggcagcgcaaaagatg

SEQ ID NO: 243494 - DNA, 103 bp, Artificial Sequence
  Synthetic Polynucleotide
taatacgactcactatagggaaaggctcattctgtcgacgtagagcccacaacagaggagagtgggcatgacgtcgacaaacctggcggcagcgcaaaagatg

SEQ ID NO: 243495 - DNA, 103 bp, Artificial Sequence
  Synthetic Polynucleotide
taatacgactcactatagggccgtacttccaaaggctcattctgtcgacgaacagaggagacgtcgaatgaatgagcctaacctggcggcagcgcaaaagatg

SEQ ID NO: 243496 - DNA, 103 bp, Artificial Sequence
  Synthetic Polynucleotide
taatacgactcactatagggaatcagttttcatcatcgcctggcgggcttaacagaggagaaagcccatgaggcgatgaaacctggcggcagcgcaaaagatg

SEQ ID NO: 243497 - DNA, 103 bp, Artificial Sequence
  Synthetic Polynucleotide
taatacgactcactataggggccgctgcagccgtacttccaaaggctcataacagaggagaatgagcatgtggaagtacaacctggcggcagcgcaaaagatg

SEQ ID NO: 243498 - DNA, 103 bp, Artificial Sequence
  Synthetic Polynucleotide
taatacgactcactatagggtctcgttccagccgctgcagccgtacttccaacagaggagaggaagtatggctgcagcgaacctggcggcagcgcaaaagatg

SEQ ID NO: 243499 - DNA, 103 bp, Artificial Sequence
  Synthetic Polynucleotide
taatacgactcactatagggggccgtgcgctctcgttccagccgctgcagaacagaggagactgcagatgctggaacgaaacctggcggcagcgcaaaagatg

SEQ ID NO: 243500 - DNA, 103 bp, Artificial Sequence
  Synthetic Polynucleotide
taatacgactcactatagggggctcttcttggccgtgcgctctcgttccaaacagaggagatggaacatgagcgcacggaacctggcggcagcgcaaaagatg

SEQ ID NO: 243501 - DNA, 103 bp, Artificial Sequence
  Synthetic Polynucleotide
taatacgactcactatagggttgtcccgccggctcttcttggccgtgcgcaacagaggagagcgcacatgcaagaagagaacctggcggcagcgcaaaagatg

SEQ ID NO: 243502 - DNA, 103 bp, Artificial Sequence
  Synthetic Polynucleotide
taatacgactcactataggggggggtctcattgtcccgccggctcttcttaacagaggagaaagaagatgcggcgggacaacctggcggcagcgcaaaagatg

SEQ ID NO: 243503 - DNA, 103 bp, Artificial Sequence
  Synthetic Polynucleotide
taatacgactcactatagggcccgctcctcgggggtctcattgtcccgccaacagaggagaggcgggatgatgagacccaacctggcggcagcgcaaaagatg

SEQ ID NO: 243504 - DNA, 103 bp, Artificial Sequence
  Synthetic Polynucleotide
taatacgactcactatagggcgcctcacctcccgctcctcgggggtctcaaacagaggagatgagacatgcgaggagcgaacctggcggcagcgcaaaagatg

SEQ ID NO: 243505 - DNA, 103 bp, Artificial Sequence
  Synthetic Polynucleotide
taatacgactcactataggggtccctcatgcgcctcacctcccgctcctcaacagaggagagaggagatggaggtgaggaacctggcggcagcgcaaaagatg

SEQ ID NO: 243506 - DNA, 103 bp, Artificial Sequence
  Synthetic Polynucleotide
taatacgactcactatagggtggcttcacggtccctcatgcgcctcacctaacagaggagaaggtgaatggcatgagggaacctggcggcagcgcaaaagatg

SEQ ID NO: 243507 - DNA, 103 bp, Artificial Sequence
  Synthetic Polynucleotide
taatacgactcactatagggtctccaggaaaatcagttttcatcatcgccaacagaggagaggcgatatggaaaactgaaacctggcggcagcgcaaaagatg

SEQ ID NO: 243508 - DNA, 103 bp, Artificial Sequence
  Synthetic Polynucleotide
taatacgactcactatagggtgcaagcgcttggcttcacggtccctcatgaacagaggagacatgagatgccgtgaagcaacctggcggcagcgcaaaagatg

SEQ ID NO: 243509 - DNA, 103 bp, Artificial Sequence
  Synthetic Polynucleotide
taatacgactcactatagggctgcatgcgctgcaagcgcttggcttcacgaacagaggagacgtgaaatgaagcgcttgaacctggcggcagcgcaaaagatg

SEQ ID NO: 243510 - DNA, 103 bp, Artificial Sequence
  Synthetic Polynucleotide
taatacgactcactatagggcgtctgtctcctgcatgcgctgcaagcgctaacagaggagaagcgctatgagcgcatgcaacctggcggcagcgcaaaagatg

SEQ ID NO: 243511 - DNA, 103 bp, Artificial Sequence
  Synthetic Polynucleotide
taatacgactcactataggggcccgctgctcgtctgtctcctgcatgcgcaacagaggagagcgcatatgggagacagaaacctggcggcagcgcaaaagatg

SEQ ID NO: 243512 - DNA, 103 bp, Artificial Sequence
  Synthetic Polynucleotide
taatacgactcactatagggcagccggcgtgcccgctgctcgtctgtctcaacagaggagagagacaatggagcagcggaacctggcggcagcgcaaaagatg

SEQ ID NO: 243513 - DNA, 103 bp, Artificial Sequence
  Synthetic Polynucleotide
taatacgactcactataggggatcccgctgcagccggcgtgcccgctgctaacagaggagaagcagcatgcacgccggcaacctggcggcagcgcaaaagatg

SEQ ID NO: 243514 - DNA, 103 bp, Artificial Sequence
  Synthetic Polynucleotide
taatacgactcactatagggatggcctcccgatcccgctgcagccggcgtaacagaggagaacgccgatggcagcgggaaacctggcggcagcgcaaaagatg

SEQ ID NO: 243515 - DNA, 103 bp, Artificial Sequence
  Synthetic Polynucleotide
taatacgactcactatagggcttcagcctcatggcctcccgatcccgctgaacagaggagacagcggatgcgggaggccaacctggcggcagcgcaaaagatg

SEQ ID NO: 243516 - DNA, 103 bp, Artificial Sequence
  Synthetic Polynucleotide
taatacgactcactatagggcattggcccgcttcagcctcatggcctcccaacagaggagagggaggatgtgaggctgaaacctggcggcagcgcaaaagatg

SEQ ID NO: 243517 - DNA, 103 bp, Artificial Sequence
  Synthetic Polynucleotide
taatacgactcactatagggtccggggtttcattggcccgcttcagcctcaacagaggagagaggctatggcgggccaaaacctggcggcagcgcaaaagatg

SEQ ID NO: 243518 - DNA, 103 bp, Artificial Sequence
  Synthetic Polynucleotide
taatacgactcactatagggctggagggcgacgctcaagagtccctccataacagaggagaatggagatgctcttgagcaacctggcggcagcgcaaaagatg

SEQ ID NO: 243519 - DNA, 103 bp, Artificial Sequence
  Synthetic Polynucleotide
taatacgactcactatagggcacggcctctggctctggacagctttcctgaacagaggagacaggaaatgtgtccagagaacctggcggcagcgcaaaagatg

SEQ ID NO: 243520 - DNA, 103 bp, Artificial Sequence
  Synthetic Polynucleotide
taatacgactcactatagggggcgcactggccgcacgcgtagggcttctcaacagaggagagagaagatgtacgcgtgcaacctggcggcagcgcaaaagatg

SEQ ID NO: 243521 - DNA, 103 bp, Artificial Sequence
  Synthetic Polynucleotide
taatacgactcactatagggtgaaggccttggcgcactggccgcacgcgtaacagaggagaacgcgtatggccagtgcgaacctggcggcagcgcaaaagatg

SEQ ID NO: 243522 - DNA, 103 bp, Artificial Sequence
  Synthetic Polynucleotide
taatacgactcactataggggacacctgggtgaaggccttggcgcactggaacagaggagaccagtgatgcaaggccttaacctggcggcagcgcaaaagatg

SEQ ID NO: 243523 - DNA, 103 bp, Artificial Sequence
  Synthetic Polynucleotide
taatacgactcactatagggcgtcaggtgcgacacctgggtgaaggccttaacagaggagaaaggccatgacccaggtgaacctggcggcagcgcaaaagatg

SEQ ID NO: 243524 - DNA, 103 bp, Artificial Sequence
  Synthetic Polynucleotide
taatacgactcactataggggctggtgctgcgtcaggtgcgacacctgggaacagaggagacccaggatgcgcacctgaaacctggcggcagcgcaaaagatg

SEQ ID NO: 243525 - DNA, 103 bp, Artificial Sequence
  Synthetic Polynucleotide
taatacgactcactataggggtgtgcgtgcgctggtgctgcgtcaggtgcaacagaggagagcacctatggcagcaccaaacctggcggcagcgcaaaagatg

SEQ ID NO: 243526 - DNA, 103 bp, Artificial Sequence
  Synthetic Polynucleotide
taatacgactcactatagggccgctctccggtgtgcgtgcgctggtgctgaacagaggagacagcacatgcgcacgcacaacctggcggcagcgcaaaagatg

SEQ ID NO: 243527 - DNA, 103 bp, Artificial Sequence
  Synthetic Polynucleotide
taatacgactcactatagggaggggtaaggccgctctccggtgtgcgtgcaacagaggagagcacgcatgccggagagcaacctggcggcagcgcaaaagatg

SEQ ID NO: 243528 - DNA, 103 bp, Artificial Sequence
  Synthetic Polynucleotide
taatacgactcactatagggcagtcgtggcaggggtaaggccgctctccgaacagaggagacggagaatggccttacccaacctggcggcagcgcaaaagatg

SEQ ID NO: 243529 - DNA, 103 bp, Artificial Sequence
  Synthetic Polynucleotide
taatacgactcactataggggcgcttgccgcagtcgtggcaggggtaaggaacagaggagaccttacatgtgccacgacaacctggcggcagcgcaaaagatg

SEQ ID NO: 243530 - DNA, 103 bp, Artificial Sequence
  Synthetic Polynucleotide
taatacgactcactatagggccttgcaggccacggcctctggctctggacaacagaggagagtccagatgcagaggccgaacctggcggcagcgcaaaagatg

SEQ ID NO: 243531 - DNA, 103 bp, Artificial Sequence
  Synthetic Polynucleotide
taatacgactcactatagggggttgctgaagcgcttgccgcagtcgtggcaacagaggagagccacgatggcggcaagcaacctggcggcagcgcaaaagatg

SEQ ID NO: 243532 - DNA, 103 bp, Artificial Sequence
  Synthetic Polynucleotide
taatacgactcactatagggaggtgggagcggttgctgaagcgcttgccgaacagaggagacggcaaatgcttcagcaaaacctggcggcagcgcaaaagatg

SEQ ID NO: 243533 - DNA, 103 bp, Artificial Sequence
  Synthetic Polynucleotide
taatacgactcactataggggtgctggaggaggtgggagcggttgctgaaaacagaggagattcagcatgcgctcccacaacctggcggcagcgcaaaagatg

SEQ ID NO: 243534 - DNA, 103 bp, Artificial Sequence
  Synthetic Polynucleotide
taatacgactcactataggggcacgaggcggtgctggaggaggtgggagcaacagaggagagctcccatgtcctccagcaacctggcggcagcgcaaaagatg

SEQ ID NO: 243535 - DNA, 103 bp, Artificial Sequence
  Synthetic Polynucleotide
taatacgactcactatagggtcaccggtgtgcacgaggcggtgctggaggaacagaggagacctccaatgccgcctcgtaacctggcggcagcgcaaaagatg

SEQ ID NO: 243536 - DNA, 103 bp, Artificial Sequence
  Synthetic Polynucleotide
taatacgactcactataggggtagggccgctcaccggtgtgcacgaggcgaacagaggagacgcctcatgcacaccggtaacctggcggcagcgcaaaagatg

SEQ ID NO: 243537 - DNA, 103 bp, Artificial Sequence
  Synthetic Polynucleotide
taatacgactcactataggggcaggcacctgtagggccgctcaccggtgtaacagaggagaacaccgatgagcggccctaacctggcggcagcgcaaaagatg

SEQ ID NO: 243538 - DNA, 103 bp, Artificial Sequence
  Synthetic Polynucleotide
taatacgactcactataggggccccgcattgcaggcacctgtagggccgcaacagaggagagcggccatgcaggtgcctaacctggcggcagcgcaaaagatg

SEQ ID NO: 243539 - DNA, 103 bp, Artificial Sequence
  Synthetic Polynucleotide
taatacgactcactataggggctgaaggcggccccgcattgcaggcacctaacagaggagaaggtgcatgcaatgcgggaacctggcggcagcgcaaaagatg

SEQ ID NO: 243540 - DNA, 103 bp, Artificial Sequence
  Synthetic Polynucleotide
taatacgactcactatagggaggacacgtggctgaaggcggccccgcattaacagaggagaaatgcgatgccgccttcaaacctggcggcagcgcaaaagatg

SEQ ID NO: 243541 - DNA, 103 bp, Artificial Sequence
  Synthetic Polynucleotide
taatacgactcactataggggcagggtctcccttgcaggccacggcctctaacagaggagaagaggcatgggcctgcaaaacctggcggcagcgcaaaagatg

SEQ ID NO: 243542 - DNA, 103 bp, Artificial Sequence
  Synthetic Polynucleotide
taatacgactcactatagggtctataagcgaggacacgtggctgaaggcgaacagaggagacgccttatgccacgtgtcaacctggcggcagcgcaaaagatg

SEQ ID NO: 243543 - DNA, 103 bp, Artificial Sequence
  Synthetic Polynucleotide
taatacgactcactatagggcttctggtgctctataagcgaggacacgtgaacagaggagacacgtgatgtcgcttataaacctggcggcagcgcaaaagatg

SEQ ID NO: 243544 - DNA, 103 bp, Artificial Sequence
  Synthetic Polynucleotide
taatacgactcactatagggcggtgtggatcttctggtgctctataagcgaacagaggagacgcttaatgagcaccagaaacctggcggcagcgcaaaagatg

SEQ ID NO: 243545 - DNA, 103 bp, Artificial Sequence
  Synthetic Polynucleotide
taatacgactcactatagggggccgctctccggtgtggatcttctggtgcaacagaggagagcaccaatggatccacacaacctggcggcagcgcaaaagatg

SEQ ID NO: 243546 - DNA, 103 bp, Artificial Sequence
  Synthetic Polynucleotide
taatacgactcactataggggcacttgtagggccgctctccggtgtggataacagaggagaatccacatgggagagcggaacctggcggcagcgcaaaagatg

SEQ ID NO: 243547 - DNA, 103 bp, Artificial Sequence
  Synthetic Polynucleotide
taatacgactcactatagggcgcactcgccgcacttgtagggccgctctcaacagaggagagagagcatgcctacaagtaacctggcggcagcgcaaaagatg

SEQ ID NO: 243548 - DNA, 103 bp, Artificial Sequence
  Synthetic Polynucleotide
taatacgactcactatagggaaagctttgccgcactcgccgcacttgtagaacagaggagactacaaatgcggcgagtgaacctggcggcagcgcaaaagatg

SEQ ID NO: 243549 - DNA, 103 bp, Artificial Sequence
  Synthetic Polynucleotide
taatacgactcactataggggccctggctgaaagctttgccgcactcgccaacagaggagaggcgagatgggcaaagctaacctggcggcagcgcaaaagatg

SEQ ID NO: 243550 - DNA, 103 bp, Artificial Sequence
  Synthetic Polynucleotide
taatacgactcactatagggcgagcgaggagccctggctgaaagctttgcaacagaggagagcaaagatgtcagccaggaacctggcggcagcgcaaaagatg

SEQ ID NO: 243551 - DNA, 103 bp, Artificial Sequence
  Synthetic Polynucleotide
taatacgactcactatagggtggtgcagggcgagcgaggagccctggctgaacagaggagacagccaatgctcctcgctaacctggcggcagcgcaaaagatg

SEQ ID NO: 243552 - DNA, 103 bp, Artificial Sequence
  Synthetic Polynucleotide
taatacgactcactataggggctgtccccagcagggtctcccttgcaggcaacagaggagagcctgcatgggagaccctaacctggcggcagcgcaaaagatg

SEQ ID NO: 243553 - DNA, 103 bp, Artificial Sequence
  Synthetic Polynucleotide
taatacgactcactataggggtgcgtgcgctggtgcagggcgagcgaggaaacagaggagatcctcgatggccctgcacaacctggcggcagcgcaaaagatg

SEQ ID NO: 243554 - DNA, 103 bp, Artificial Sequence
  Synthetic Polynucleotide
taatacgactcactataggggctcgcccgtgtgcgtgcgctggtgcagggaacagaggagaccctgcatgagcgcacgcaacctggcggcagcgcaaaagatg

SEQ ID NO: 243555 - DNA, 103 bp, Artificial Sequence
  Synthetic Polynucleotide
taatacgactcactataggggtgtagggccgctcgcccgtgtgcgtgcgcaacagaggagagcgcacatgcacgggcgaaacctggcggcagcgcaaaagatg

SEQ ID NO: 243556 - DNA, 103 bp, Artificial Sequence
  Synthetic Polynucleotide
taatacgactcactatagggctcggggcaggtgtagggccgctcgcccgtaacagaggagaacgggcatgcggccctacaacctggcggcagcgcaaaagatg

SEQ ID NO: 243557 - DNA, 103 bp, Artificial Sequence
  Synthetic Polynucleotide
taatacgactcactatagggccttgccgcactcggggcaggtgtagggccaacagaggagaggccctatgcctgccccgaacctggcggcagcgcaaaagatg

SEQ ID NO: 243558 - DNA, 103 bp, Artificial Sequence
  Synthetic Polynucleotide
taatacgactcactatagggttgctgaaggccttgccgcactcggggcagaacagaggagactgcccatggtgcggcaaaacctggcggcagcgcaaaagatg

SEQ ID NO: 243559 - DNA, 103 bp, Artificial Sequence
  Synthetic Polynucleotide
taatacgactcactataggggtaggagcggttgctgaaggccttgccgcaaacagaggagatgcggcatggccttcagcaacctggcggcagcgcaaaagatg

SEQ ID NO: 243560 - DNA, 103 bp, Artificial Sequence
  Synthetic Polynucleotide
taatacgactcactataggggctggatcaggtaggagcggttgctgaaggaacagaggagaccttcaatgaccgctcctaacctggcggcagcgcaaaagatg

SEQ ID NO: 243561 - DNA, 103 bp, Artificial Sequence
  Synthetic Polynucleotide
taatacgactcactatagggacgatgtggtgctggatcaggtaggagcggaacagaggagaccgctcatgcctgatccaaacctggcggcagcgcaaaagatg

SEQ ID NO: 243562 - DNA, 103 bp, Artificial Sequence
  Synthetic Polynucleotide
taatacgactcactatagggcccggtgtgcacgatgtggtgctggatcagaacagaggagactgatcatgcaccacatcaacctggcggcagcgcaaaagatg

SEQ ID NO: 243563 - DNA, 103 bp, Artificial Sequence
  Synthetic Polynucleotide
taatacgactcactataggggttcctgcatgctgtccccagcagggtctcaacagaggagagagaccatgctggggacaaacctggcggcagcgcaaaagatg

SEQ ID NO: 243564 - DNA, 103 bp, Artificial Sequence
  Synthetic Polynucleotide
taatacgactcactatagggagggcttctccccggtgtgcacgatgtggtaacagaggagaaccacaatgtgcacaccgaacctggcggcagcgcaaaagatg

SEQ ID NO: 243565 - DNA, 103 bp, Artificial Sequence
  Synthetic Polynucleotide
taatacgactcactatagggctgcactcgtagggcttctccccggtgtgcaacagaggagagcacacatgggagaagccaacctggcggcagcgcaaaagatg

SEQ ID NO: 243566 - DNA, 103 bp, Artificial Sequence
  Synthetic Polynucleotide
taatacgactcactatagggcccgcagccgctgcactcgtagggcttctcaacagaggagagagaagatgtacgagtgcaacctggcggcagcgcaaaagatg

SEQ ID NO: 243567 - DNA, 103 bp, Artificial Sequence
  Synthetic Polynucleotide
taatacgactcactatagggtgaaggccttcccgcagccgctgcactcgtaacagaggagaacgagtatggcggctgcgaacctggcggcagcgcaaaagatg

SEQ ID NO: 243568 - DNA, 103 bp, Artificial Sequence
  Synthetic Polynucleotide
taatacgactcactataggggaggagaagctgaaggccttcccgcagccgaacagaggagacggctgatggaaggccttaacctggcggcagcgcaaaagatg

SEQ ID NO: 243569 - DNA, 103 bp, Artificial Sequence
  Synthetic Polynucleotide
taatacgactcactataggggatgagcgcggaggagaagctgaaggccttaacagaggagaaaggccatgagcttctccaacctggcggcagcgcaaaagatg

SEQ ID NO: 243570 - DNA, 103 bp, Artificial Sequence
  Synthetic Polynucleotide
taatacgactcactatagggtctggtgtcggatgagcgcggaggagaagcaacagaggagagcttctatgccgcgctcaaacctggcggcagcgcaaaagatg

SEQ ID NO: 243571 - DNA, 103 bp, Artificial Sequence
  Synthetic Polynucleotide
taatacgactcactataggggcatgcgtcctctggtgtcggatgagcgcgaacagaggagacgcgctatgccgacaccaaacctggcggcagcgcaaaagatg

SEQ ID NO: 243572 - DNA, 103 bp, Artificial Sequence
  Synthetic Polynucleotide
taatacgactcactatagggcgaactgtctgcatgcgtcctctggtgtcgaacagaggagacgacacatgaggacgcataacctggcggcagcgcaaaagatg

SEQ ID NO: 243573 - DNA, 103 bp, Artificial Sequence
  Synthetic Polynucleotide
taatacgactcactatagggaaaggcgtcccgaactgtctgcatgcgtccaacagaggagaggacgcatgcagacagttaacctggcggcagcgcaaaagatg

SEQ ID NO: 243574 - DNA, 103 bp, Artificial Sequence
  Synthetic Polynucleotide
taatacgactcactatagggaattcatcgcgttcctgcatgctgtccccaaacagaggagatggggaatgcatgcaggaaacctggcggcagcgcaaaagatg

SEQ ID NO: 243575 - DNA, 103 bp, Artificial Sequence
  Synthetic Polynucleotide
taatacgactcactatagggggagctgggcaaaggcgtcccgaactgtctaacagaggagaagacagatggggacgcctaacctggcggcagcgcaaaagatg

SEQ ID NO: 243576 - DNA, 103 bp, Artificial Sequence
  Synthetic Polynucleotide
taatacgactcactataggggtcaggcgtgggagctgggcaaaggcgtccaacagaggagaggacgcatgtgcccagctaacctggcggcagcgcaaaagatg

SEQ ID NO: 243577 - DNA, 103 bp, Artificial Sequence
  Synthetic Polynucleotide
taatacgactcactatagggcaggtgttgagtcaggcgtgggagctgggcaacagaggagagcccagatgccacgcctgaacctggcggcagcgcaaaagatg

SEQ ID NO: 243578 - DNA, 103 bp, Artificial Sequence
  Synthetic Polynucleotide
taatacgactcactatagggtgtgagagcccaggtgttgagtcaggcgtgaacagaggagacacgccatgctcaacaccaacctggcggcagcgcaaaagatg

SEQ ID NO: 243579 - DNA, 103 bp, Artificial Sequence
  Synthetic Polynucleotide
taatacgactcactatagggttctcctccctgtgagagcccaggtgttgaaacagaggagatcaacaatggggctctcaaacctggcggcagcgcaaaagatg

SEQ ID NO: 243580 - DNA, 103 bp, Artificial Sequence
  Synthetic Polynucleotide
taatacgactcactataggggttgacaggtttctcctccctgtgagagccaacagaggagaggctctatgagggaggagaacctggcggcagcgcaaaagatg

SEQ ID NO: 243581 - DNA, 103 bp, Artificial Sequence
  Synthetic Polynucleotide
taatacgactcactataggggggcacccctgttgacaggtttctcctcccaacagaggagagggaggatgaacctgtcaaacctggcggcagcgcaaaagatg

SEQ ID NO: 243582 - DNA, 103 bp, Artificial Sequence
  Synthetic Polynucleotide
taatacgactcactataggggtttctgccagggcacccctgttgacaggtaacagaggagaacctgtatgcaggggtgcaacctggcggcagcgcaaaagatg

SEQ ID NO: 243583 - DNA, 103 bp, Artificial Sequence
  Synthetic Polynucleotide
taatacgactcactataggggtccacgcgggtttctgccagggcacccctaacagaggagaaggggtatgctggcagaaaacctggcggcagcgcaaaagatg

SEQ ID NO: 243584 - DNA, 103 bp, Artificial Sequence
  Synthetic Polynucleotide
taatacgactcactatagggtcttctgctggtccacgcgggtttctgccaaacagaggagatggcagatgcccgcgtggaacctggcggcagcgcaaaagatg

SEQ ID NO: 243585 - DNA, 103 bp, Artificial Sequence
  Synthetic Polynucleotide
taatacgactcactataggggattcggctgaattcatcgcgttcctgcataacagaggagaatgcagatgcgcgatgaaaacctggcggcagcgcaaaagatg

SEQ ID NO: 243586 - DNA, 103 bp, Artificial Sequence
  Synthetic Polynucleotide
taatacgactcactatagggtggttcttgggattcggctgaattcatcgcaacagaggagagcgatgatgtcagccgaaaacctggcggcagcgcaaaagatg

SEQ ID NO: 243587 - DNA, 103 bp, Artificial Sequence
  Synthetic Polynucleotide
taatacgactcactataggggggctcgatatggttcttgggattcggctgaacagaggagacagccgatgcccaagaacaacctggcggcagcgcaaaagatg

SEQ ID NO: 243588 - DNA, 103 bp, Artificial Sequence
  Synthetic Polynucleotide
taatacgactcactatagggggtagcagcagggctcgatatggttcttggaacagaggagaccaagaatgatatcgagcaacctggcggcagcgcaaaagatg

SEQ ID NO: 243589 - DNA, 103 bp, Artificial Sequence
  Synthetic Polynucleotide
taatacgactcactatagggactctgcgccctggagggcgacgctcaagaaacagaggagatcttgaatgtcgccctccaacctggcggcagcgcaaaagatg

SEQ ID NO: 243590 - DNA, 103 bp, Artificial Sequence
  Synthetic Polynucleotide
taatacgactcactatagggcactggcttgggtagcagcagggctcgataaacagaggagatatcgaatgctgctgctaaacctggcggcagcgcaaaagatg

SEQ ID NO: 243591 - DNA, 103 bp, Artificial Sequence
  Synthetic Polynucleotide
taatacgactcactatagggtcgtcggggacactggcttgggtagcagcaaacagaggagatgctgcatgccaagccagaacctggcggcagcgcaaaagatg

SEQ ID NO: 243592 - DNA, 103 bp, Artificial Sequence
  Synthetic Polynucleotide
taatacgactcactatagggggaactgctgtcgtcggggacactggcttgaacagaggagacaagccatggtccccgacaacctggcggcagcgcaaaagatg

SEQ ID NO: 243593 - DNA, 103 bp, Artificial Sequence
  Synthetic Polynucleotide
taatacgactcactatagggtgcacctccgggaactgctgtcgtcggggaaacagaggagatccccgatgacagcagttaacctggcggcagcgcaaaagatg

SEQ ID NO: 243594 - DNA, 103 bp, Artificial Sequence
  Synthetic Polynucleotide
taatacgactcactatagggccaggcgcgctgcacctccgggaactgctgaacagaggagacagcagatgccggaggtgaacctggcggcagcgcaaaagatg

SEQ ID NO: 243595 - DNA, 103 bp, Artificial Sequence
  Synthetic Polynucleotide
taatacgactcactatagggcgggctctccccaggcgcgctgcacctccgaacagaggagacggaggatgagcgcgcctaacctggcggcagcgcaaaagatg

SEQ ID NO: 243596 - DNA, 103 bp, Artificial Sequence
  Synthetic Polynucleotide
taatacgactcactataggggcctctccttcgggctctccccaggcgcgcaacagaggagagcgcgcatggggagagccaacctggcggcagcgcaaaagatg

SEQ ID NO: 243597 - DNA, 103 bp, Artificial Sequence
  Synthetic Polynucleotide
taatacgactcactatagggctgtcaggatgcctctccttcgggctctccaacagaggagaggagagatggaaggagagaacctggcggcagcgcaaaagatg

SEQ ID NO: 243598 - DNA, 103 bp, Artificial Sequence
  Synthetic Polynucleotide
taatacgactcactatagggccgctggcggctgtcaggatgcctctccttaacagaggagaaaggagatgcatcctgacaacctggcggcagcgcaaaagatg

SEQ ID NO: 243599 - DNA, 103 bp, Artificial Sequence
  Synthetic Polynucleotide
taatacgactcactatagggcacctctctcccgctggcggctgtcaggataacagaggagaatcctgatggccgccagcaacctggcggcagcgcaaaagatg

SEQ ID NO: 243600 - DNA, 103 bp, Artificial Sequence
  Synthetic Polynucleotide
taatacgactcactatagggtttccttccaactctgcgccctggagggcgaacagaggagacgccctatggggcgcagaaacctggcggcagcgcaaaagatg

SEQ ID NO: 243601 - DNA, 103 bp, Artificial Sequence
  Synthetic Polynucleotide
taatacgactcactatagggttggggcctccacctctctcccgctggcggaacagaggagaccgccaatgggagagaggaacctggcggcagcgcaaaagatg

SEQ ID NO: 243602 - DNA, 103 bp, Artificial Sequence
  Synthetic Polynucleotide
taatacgactcactatagggccacggcttcttggggcctccacctctctcaacagaggagagagagaatgggaggccccaacctggcggcagcgcaaaagatg

SEQ ID NO: 243603 - DNA, 103 bp, Artificial Sequence
  Synthetic Polynucleotide
taatacgactcactatagggccccgcatttccacggcttcttggggcctcaacagaggagagaggccatgagaagccgtaacctggcggcagcgcaaaagatg

SEQ ID NO: 243604 - DNA, 103 bp, Artificial Sequence
  Synthetic Polynucleotide
taatacgactcactatagggttcccgcagtccccgcatttccacggcttcaacagaggagagaagccatggaaatgcggaacctggcggcagcgcaaaagatg

SEQ ID NO: 243605 - DNA, 103 bp, Artificial Sequence
  Synthetic Polynucleotide
taatacgactcactataggggctgaaggccttcccgcagtccccgcatttaacagaggagaaaatgcatggactgcgggaacctggcggcagcgcaaaagatg

SEQ ID NO: 243606 - DNA, 103 bp, Artificial Sequence
  Synthetic Polynucleotide
taatacgactcactatagggctgaacagtagctgaaggccttcccgcagtaacagaggagaactgcgatgaggccttcaaacctggcggcagcgcaaaagatg

SEQ ID NO: 243607 - DNA, 103 bp, Artificial Sequence
  Synthetic Polynucleotide
taatacgactcactatagggaagatgaacgctgaacagtagctgaaggccaacagaggagaggccttatgctactgttcaacctggcggcagcgcaaaagatg

SEQ ID NO: 243608 - DNA, 103 bp, Artificial Sequence
  Synthetic Polynucleotide
taatacgactcactatagggtctctggtgtaagatgaacgctgaacagtaaacagaggagatactgtatggcgttcatcaacctggcggcagcgcaaaagatg

SEQ ID NO: 243609 - DNA, 103 bp, Artificial Sequence
  Synthetic Polynucleotide
taatacgactcactatagggcggtgtggattctctggtgtaagatgaacgaacagaggagacgttcaatgtacaccagaaacctggcggcagcgcaaaagatg

SEQ ID NO: 243610 - DNA, 103 bp, Artificial Sequence
  Synthetic Polynucleotide
taatacgactcactatagggggcttctccccggtgtggattctctggtgtaacagaggagaacaccaatgaatccacacaacctggcggcagcgcaaaagatg

SEQ ID NO: 243611 - DNA, 103 bp, Artificial Sequence
  Synthetic Polynucleotide
taatacgactcactataggggtgtttccagtttccttccaactctgcgccaacagaggagaggcgcaatgttggaaggaaacctggcggcagcgcaaaagatg

SEQ ID NO: 243612 - DNA, 103 bp, Artificial Sequence
  Synthetic Polynucleotide
taatacgactcactataggggcacgcaaatggcttctccccggtgtggataacagaggagaatccacatgggggagaagaacctggcggcagcgcaaaagatg

SEQ ID NO: 243613 - DNA, 103 bp, Artificial Sequence
  Synthetic Polynucleotide
taatacgactcactatagggcgcactcggggcacgcaaatggcttctcccaacagaggagagggagaatgcatttgcgtaacctggcggcagcgcaaaagatg

SEQ ID NO: 243614 - DNA, 103 bp, Artificial Sequence
  Synthetic Polynucleotide
taatacgactcactatagggaaggccttgccgcactcggggcacgcaaataacagaggagaatttgcatgccccgagtgaacctggcggcagcgcaaaagatg

SEQ ID NO: 243615 - DNA, 103 bp, Artificial Sequence
  Synthetic Polynucleotide
taatacgactcactataggggctctggctgaaggccttgccgcactcgggaacagaggagacccgagatgggcaaggccaacctggcggcagcgcaaaagatg

SEQ ID NO: 243616 - DNA, 103 bp, Artificial Sequence
  Synthetic Polynucleotide
taatacgactcactatagggtcaggtgcacgctctggctgaaggccttgcaacagaggagagcaaggatgtcagccagaaacctggcggcagcgcaaaagatg

SEQ ID NO: 243617 - DNA, 103 bp, Artificial Sequence
  Synthetic Polynucleotide
taatacgactcactatagggtggtgcagggtcaggtgcacgctctggctgaacagaggagacagccaatgcgtgcacctaacctggcggcagcgcaaaagatg

SEQ ID NO: 243618 - DNA, 103 bp, Artificial Sequence
  Synthetic Polynucleotide
taatacgactcactataggggtgcgtgcgctggtgcagggtcaggtgcacaacagaggagagtgcacatgaccctgcacaacctggcggcagcgcaaaagatg

SEQ ID NO: 243619 - DNA, 103 bp, Artificial Sequence
  Synthetic Polynucleotide
taatacgactcactatagggtctcgcccgtgtgcgtgcgctggtgcagggaacagaggagaccctgcatgagcgcacgcaacctggcggcagcgcaaaagatg

SEQ ID NO: 243620 - DNA, 103 bp, Artificial Sequence; identical to SEQ ID NO: 237061
  Synthetic Polynucleotide

SEQ ID NO: 243621 - DNA, 103 bp, Artificial Sequence
  Synthetic Polynucleotide
taatacgactcactatagggctcgtggcaggcgtagggcttctcgcccgtaacagaggagaacgggcatgaagccctacaacctggcggcagcgcaaaagatg

SEQ ID NO: 243622 - DNA, 103 bp, Artificial Sequence
  Synthetic Polynucleotide
taatacgactcactatagggcctggccctcgtgtttccagtttccttccaaacagaggagatggaagatgactggaaacaacctggcggcagcgcaaaagatg

SEQ ID NO: 243623 - DNA, 103 bp, Artificial Sequence
  Synthetic Polynucleotide
taatacgactcactatagggccttgccgcactcgtggcaggcgtagggctaacagaggagaagccctatgcctgccacgaacctggcggcagcgcaaaagatg

SEQ ID NO: 243624 - DNA, 103 bp, Artificial Sequence
  Synthetic Polynucleotide
taatacgactcactatagggtggctgaaggccttgccgcactcgtggcagaacagaggagactgccaatggtgcggcaaaacctggcggcagcgcaaaagatg

SEQ ID NO: 243625 - DNA, 103 bp, Artificial Sequence
  Synthetic Polynucleotide
taatacgactcactataggggtacgagccctggctgaaggccttgccgcaaacagaggagatgcggcatggccttcagcaacctggcggcagcgcaaaagatg

SEQ ID NO: 243626 - DNA, 103 bp, Artificial Sequence
  Synthetic Polynucleotide
taatacgactcactataggggggacgccaggtacgagccctggctgaaggaacagaggagaccttcaatgagggctcgtaacctggcggcagcgcaaaagatg

SEQ ID NO: 243627 - DNA, 103 bp, Artificial Sequence
  Synthetic Polynucleotide
taatacgactcactataggggtgcgccagtgggacgccaggtacgagcccaacagaggagagggctcatgcctggcgtcaacctggcggcagcgcaaaagatg

SEQ ID NO: 243628 - DNA, 103 bp, Artificial Sequence
  Synthetic Polynucleotide
taatacgactcactataggggcccgtgtgcgtgcgccagtgggacgccagaacagaggagactggcgatgcactggcgcaacctggcggcagcgcaaaagatg

SEQ ID NO: 243629 - DNA, 103 bp, Artificial Sequence
  Synthetic Polynucleotide
taatacgactcactataggggcggcttctcgcccgtgtgcgtgcgccagtaacagaggagaactggcatgcgcacacggaacctggcggcagcgcaaaagatg

SEQ ID NO: 243630 - DNA, 103 bp, Artificial Sequence
  Synthetic Polynucleotide
taatacgactcactataggggcgcagcggtgcggcttctcgcccgtgtgcaacagaggagagcacacatgcgagaagccaacctggcggcagcgcaaaagatg

SEQ ID NO: 243631 - DNA, 103 bp, Artificial Sequence
  Synthetic Polynucleotide
taatacgactcactataggggccgcagtcggcgcagcggtgcggcttctcaacagaggagagagaagatgcaccgctgcaacctggcggcagcgcaaaagatg

SEQ ID NO: 243632 - DNA, 103 bp, Artificial Sequence
  Synthetic Polynucleotide
taatacgactcactatagggtgaaggccttgccgcagtcggcgcagcggtaacagaggagaaccgctatgccgactgcgaacctggcggcagcgcaaaagatg

SEQ ID NO: 243633 - DNA, 103 bp, Artificial Sequence
  Synthetic Polynucleotide
taatacgactcactatagggaggtcctcaacctggccctcgtgtttccagaacagaggagactggaaatgcgagggccaaacctggcggcagcgcaaaagatg

SEQ ID NO: 243634 - DNA, 103 bp, Artificial Sequence
  Synthetic Polynucleotide
taatacgactcactataggggtgacgcgcgtgaaggccttgccgcagtcgaacagaggagacgactgatgcaaggccttaacctggcggcagcgcaaaagatg

SEQ ID NO: 243635 - DNA, 103 bp, Artificial Sequence
  Synthetic Polynucleotide
taatacgactcactatagggggtcaggtgcgtgacgcgcgtgaaggccttaacagaggagaaaggccatgacgcgcgtcaacctggcggcagcgcaaaagatg

SEQ ID NO: 243636 - DNA, 103 bp, Artificial Sequence
  Synthetic Polynucleotide
taatacgactcactataggggccggtgctgggtcaggtgcgtgacgcgcgaacagaggagacgcgcgatgcgcacctgaaacctggcggcagcgcaaaagatg

SEQ ID NO: 243637 - DNA, 103 bp, Artificial Sequence
  Synthetic Polynucleotide
taatacgactcactataggggtgtgcacgcgccggtgctgggtcaggtgcaacagaggagagcacctatgccagcaccgaacctggcggcagcgcaaaagatg

SEQ ID NO: 243638 - DNA, 103 bp, Artificial Sequence
  Synthetic Polynucleotide
taatacgactcactatagggccgctcgcccgtgtgcacgcgccggtgctgaacagaggagacagcacatgcgcgtgcacaacctggcggcagcgcaaaagatg

SEQ ID NO: 243639 - DNA, 103 bp, Artificial Sequence
  Synthetic Polynucleotide
taatacgactcactatagggacgcgtagggccgctcgcccgtgtgcacgcaacagaggagagcgtgcatgcgggcgagcaacctggcggcagcgcaaaagatg

SEQ ID NO: 243640 - DNA, 103 bp, Artificial Sequence
  Synthetic Polynucleotide
taatacgactcactatagggcactgggcgcacgcgtagggccgctcgcccaacagaggagagggcgaatggccctacgcaacctggcggcagcgcaaaagatg

SEQ ID NO: 243641 - DNA, 103 bp, Artificial Sequence
  Synthetic Polynucleotide
taatacgactcactatagggcgccttggcgcactgggcgcacgcgtagggaacagaggagaccctacatgtgcgcccagaacctggcggcagcgcaaaagatg

SEQ ID NO: 243642 - DNA, 103 bp, Artificial Sequence
  Synthetic Polynucleotide
taatacgactcactatagggggttgcggaacgccttggcgcactgggcgcaacagaggagagcgcccatggcgccaaggaacctggcggcagcgcaaaagatg

SEQ ID NO: 243643 - DNA, 103 bp, Artificial Sequence
  Synthetic Polynucleotide
taatacgactcactatagggagggacgagcggttgcggaacgccttggcgaacagaggagacgccaaatggttccgcaaaacctggcggcagcgcaaaagatg

SEQ ID NO: 243644 - DNA, 103 bp, Artificial Sequence
  Synthetic Polynucleotide
taatacgactcactataggggttttcctgcaggtcctcaacctggccctcaacagaggagagagggcatggttgaggacaacctggcggcagcgcaaaagatg

SEQ ID NO: 243645 - DNA, 103 bp, Artificial Sequence
  Synthetic Polynucleotide
taatacgactcactataggggtgctctatcagggacgagcggttgcggaaaacagaggagattccgcatgcgctcgtccaacctggcggcagcgcaaaagatg

SEQ ID NO: 243646 - DNA, 103 bp, Artificial Sequence
  Synthetic Polynucleotide
taatacgactcactatagggggatgcgctggtgctctatcagggacgagcaacagaggagagctcgtatgtgatagagcaacctggcggcagcgcaaaagatg

SEQ ID NO: 243647 - DNA, 103 bp, Artificial Sequence
  Synthetic Polynucleotide
taatacgactcactatagggtcaccggtgtggatgcgctggtgctctatcaacagaggagagatagaatgccagcgcataacctggcggcagcgcaaaagatg

SEQ ID NO: 243648 - DNA, 103 bp, Artificial Sequence
  Synthetic Polynucleotide
taatacgactcactataggggtagggcttctcaccggtgtggatgcgctgaacagaggagacagcgcatgcacaccggtaacctggcggcagcgcaaaagatg

SEQ ID NO: 243649 - DNA, 103 bp, Artificial Sequence
  Synthetic Polynucleotide
taatacgactcactatagggcggagcactcgtagggcttctcaccggtgtaacagaggagaacaccgatgagaagccctaacctggcggcagcgcaaaagatg

SEQ ID NO: 243650 - DNA, 103 bp, Artificial Sequence
  Synthetic Polynucleotide
taatacgactcactatagggttggcgcacgcggagcactcgtagggcttcaacagaggagagaagccatgcgagtgctcaacctggcggcagcgcaaaagatg

SEQ ID NO: 243651 - DNA, 103 bp, Artificial Sequence
  Synthetic Polynucleotide
taatacgactcactataggggcggaaggccttggcgcacgcggagcactcaacagaggagagagtgcatggcgtgcgccaacctggcggcagcgcaaaagatg

SEQ ID NO: 243652 - DNA, 103 bp, Artificial Sequence
  Synthetic Polynucleotide
taatacgactcactatagggctgaggagaagcggaaggccttggcgcacgaacagaggagacgtgcgatgaggccttccaacctggcggcagcgcaaaagatg

SEQ ID NO: 243653 - DNA, 103 bp, Artificial Sequence
  Synthetic Polynucleotide
taatacgactcactatagggcggatgagcgctgaggagaagcggaaggccaacagaggagaggccttatgcttctcctcaacctggcggcagcgcaaaagatg

SEQ ID NO: 243654 - DNA, 103 bp, Artificial Sequence
  Synthetic Polynucleotide
taatacgactcactataggggcgctggtggcggatgagcgctgaggagaaaacagaggagattctccatggcgctcatcaacctggcggcagcgcaaaagatg

SEQ ID NO: 243655 - DNA, 103 bp, Artificial Sequence
  Synthetic Polynucleotide
taatacgactcactatagggagctttcctggttttcctgcaggtcctcaaaacagaggagattgaggatgtgcaggaaaaacctggcggcagcgcaaaagatg

SEQ ID NO: 243656 - DNA, 103 bp, Artificial Sequence
  Synthetic Polynucleotide
taatacgactcactatagggccgtgtggatgcgctggtggcggatgagcgaacagaggagacgctcaatggccaccagcaacctggcggcagcgcaaaagatg

SEQ ID NO: 243657 - DNA, 103 bp, Artificial Sequence
  Synthetic Polynucleotide
taatacgactcactatagggggcttctcctccgtgtggatgcgctggtggaacagaggagaccaccaatgcatccacacaacctggcggcagcgcaaaagatg

SEQ ID NO: 243658 - DNA, 103 bp, Artificial Sequence
  Synthetic Polynucleotide
taatacgactcactataggggcagcggtagggcttctcctccgtgtggataacagaggagaatccacatggaggagaagaacctggcggcagcgcaaaagatg

SEQ ID NO: 243659 - DNA, 103 bp, Artificial Sequence
  Synthetic Polynucleotide
taatacgactcactatagggcgcactggccgcagcggtagggcttctcctaacagaggagaaggagaatgcctaccgctaacctggcggcagcgcaaaagatg

SEQ ID NO: 243660 - DNA, 103 bp, Artificial Sequence
  Synthetic Polynucleotide
taatacgactcactatagggaaggccttggcgcactggccgcagcggtagaacagaggagactaccgatgcggccagtgaacctggcggcagcgcaaaagatg

SEQ ID NO: 243661 - DNA, 103 bp, Artificial Sequence
  Synthetic Polynucleotide
taatacgactcactataggggatctgcgcgaaggccttggcgcactggccaacagaggagaggccagatggccaaggccaacctggcggcagcgcaaaagatg

SEQ ID NO: 243662 - DNA, 103 bp, Artificial Sequence
  Synthetic Polynucleotide
taatacgactcactatagggtcaggtgcgcgatctgcgcgaaggccttggaacagaggagaccaaggatgtcgcgcagaaacctggcggcagcgcaaaagatg

SEQ ID NO: 243663 - DNA, 103 bp, Artificial Sequence
  Synthetic Polynucleotide
taatacgactcactatagggcggtgctgggtcaggtgcgcgatctgcgcgaacagaggagacgcgcaatgcgcgcacctaacctggcggcagcgcaaaagatg

SEQ ID NO: 243664 - DNA, 103 bp, Artificial Sequence
  Synthetic Polynucleotide
taatacgactcactataggggtgcacgcgccggtgctgggtcaggtgcgcaacagaggagagcgcacatgacccagcacaacctggcggcagcgcaaaagatg

SEQ ID NO: 243665 - DNA, 103 bp, Artificial Sequence
  Synthetic Polynucleotide
taatacgactcactatagggtctcgcccgtgtgcacgcgccggtgctgggaacagaggagacccagcatgggcgcgtgcaacctggcggcagcgcaaaagatg

SEQ ID NO: 243666 - DNA, 103 bp, Artificial Sequence
  Synthetic Polynucleotide
taatacgactcactatagggggctctggacagctttcctggttttcctgcaacagaggagagcaggaatgccaggaaagaacctggcggcagcgcaaaagatg

SEQ ID NO: 243667 - DNA, 103 bp, Artificial Sequence
  Synthetic Polynucleotide
taatacgactcactataggggtgtagggcttctcgcccgtgtgcacgcgcaacagaggagagcgcgtatgcacgggcgaaacctggcggcagcgcaaaagatg

SEQ ID NO: 243668 - DNA, 103 bp, Artificial Sequence
  Synthetic Polynucleotide
taatacgactcactataggggtcctggcacgtgtagggcttctcgcccgtaacagaggagaacgggcatgaagccctacaacctggcggcagcgcaaaagatg

SEQ ID NO: 243669 - DNA, 103 bp, Artificial Sequence
  Synthetic Polynucleotide
taatacgactcactataggggcgcgccgcagtcctggcacgtgtagggctaacagaggagaagccctatgcgtgccaggaacctggcggcagcgcaaaagatg

SEQ ID NO: 243670 - DNA, 103 bp, Artificial Sequence
  Synthetic Polynucleotide
taatacgactcactatagggtggctgaagagcgcgccgcagtcctggcacaacagaggagagtgccaatgctgcggcgcaacctggcggcagcgcaaaagatg

SEQ ID NO: 243671 - DNA, 103 bp, Artificial Sequence
  Synthetic Polynucleotide
taatacgactcactatagggagaggcgctctggctgaagagcgcgccgcaaacagaggagatgcggcatgctcttcagcaacctggcggcagcgcaaaagatg

SEQ ID NO: 243672 - DNA, 103 bp, Artificial Sequence
  Synthetic Polynucleotide
taatacgactcactataggggctcggccagagaggcgctctggctgaagaaacagaggagatcttcaatgagagcgcctaacctggcggcagcgcaaaagatg

SEQ ID NO: 243673 - DNA, 103 bp, Artificial Sequence
  Synthetic Polynucleotide
taatacgactcactatagggatgcgccggtgctcggccagagaggcgctcaacagaggagagagcgcatgtctggccgaaacctggcggcagcgcaaaagatg

SEQ ID NO: 243674 - DNA, 103 bp, Artificial Sequence
  Synthetic Polynucleotide
taatacgactcactataggggcctgtgtggatgcgccggtgctcggccagaacagaggagactggccatgcaccggcgcaacctggcggcagcgcaaaagatg

SEQ ID NO: 243675 - DNA, 103 bp, Artificial Sequence
  Synthetic Polynucleotide
taatacgactcactatagggagggcttctcgcctgtgtggatgcgccggtaacagaggagaaccggcatgtccacacagaacctggcggcagcgcaaaagatg

SEQ ID NO: 243676 - DNA, 103 bp, Artificial Sequence
  Synthetic Polynucleotide
taatacgactcactatagggccgcacgcgtagggcttctcgcctgtgtggaacagaggagaccacacatgcgagaagccaacctggcggcagcgcaaaagatg

SEQ ID NO: 243677 - DNA, 103 bp, Artificial Sequence
  Synthetic Polynucleotide
taatacgactcactatagggggccacatctctaaattgcaatggtcccataacagaggagaatgggaatgttgcaatttaacctggcggcagcgcaaaagatg

SEQ ID NO: 243678 - DNA, 103 bp, Artificial Sequence
  Synthetic Polynucleotide
taatacgactcactatagggcaggttactgtagttctctaacatcacattaacagaggagaaatgtgatgttagagaacaacctggcggcagcgcaaaagatg

SEQ ID NO: 243679 - DNA, 103 bp, Artificial Sequence
  Synthetic Polynucleotide
taatacgactcactatagggtggtttctctccagtatgaattctcttatgaacagaggagacataagatgattcatactaacctggcggcagcgcaaaagatg

SEQ ID NO: 243680 - DNA, 103 bp, Artificial Sequence
  Synthetic Polynucleotide
taatacgactcactatagggtacacttgtatggtttctctccagtatgaaaacagaggagattcataatggagagaaacaacctggcggcagcgcaaaagatg

SEQ ID NO: 243681 - DNA, 103 bp, Artificial Sequence
  Synthetic Polynucleotide
taatacgactcactatagggccacatttattacacttgtatggtttctctaacagaggagaagagaaatgatacaagtgaacctggcggcagcgcaaaagatg

SEQ ID NO: 243682 - DNA, 103 bp, Artificial Sequence
  Synthetic Polynucleotide
taatacgactcactatagggaaaggctttgccacatttattacacttgtaaacagaggagatacaagatgaataaatgtaacctggcggcagcgcaaaagatg

SEQ ID NO: 243683 - DNA, 103 bp, Artificial Sequence
  Synthetic Polynucleotide
taatacgactcactatagggaggatgcaataaaggctttgccacatttataacagaggagaataaatatggcaaagcctaacctggcggcagcgcaaaagatg

SEQ ID NO: 243684 - DNA, 103 bp, Artificial Sequence
  Synthetic Polynucleotide
taatacgactcactatagggctaagggttgaggatgcaataaaggctttgaacagaggagacaaagcatgtattgcatcaacctggcggcagcgcaaaagatg

SEQ ID NO: 243685 - DNA, 103 bp, Artificial Sequence
  Synthetic Polynucleotide
taatacgactcactatagggctcatgtctactaagggttgaggatgcaataacagaggagaattgcaatgtcaacccttaacctggcggcagcgcaaaagatg

SEQ ID NO: 243686 - DNA, 103 bp, Artificial Sequence
  Synthetic Polynucleotide
taatacgactcactatagggtatgaatgaactcatgtctactaagggttgaacagaggagacaacccatggtagacatgaacctggcggcagcgcaaaagatg

SEQ ID NO: 243687 - DNA, 103 bp, Artificial Sequence
  Synthetic Polynucleotide
taatacgactcactatagggttctttcccatatgaatgaactcatgtctaaacagaggagatagacaatggttcattcaaacctggcggcagcgcaaaagatg

SEQ ID NO: 243688 - DNA, 103 bp, Artificial Sequence
  Synthetic Polynucleotide
taatacgactcactatagggtttgtaatgtttctttcccatatgaatgaaaacagaggagattcattatgatgggaaagaacctggcggcagcgcaaaagatg

SEQ ID NO: 243689 - DNA, 103 bp, Artificial Sequence
  Synthetic Polynucleotide
taatacgactcactatagggcaaggaagaccaggttactgtagttctctaaacagaggagatagagaatgacagtaaccaacctggcggcagcgcaaaagatg

SEQ ID NO: 243690 - DNA, 103 bp, Artificial Sequence
  Synthetic Polynucleotide
taatacgactcactatagggattcttcacatttgtaatgtttctttcccaaacagaggagatgggaaatgaacattacaaacctggcggcagcgcaaaagatg

SEQ ID NO: 243691 - DNA, 103 bp, Artificial Sequence
  Synthetic Polynucleotide
taatacgactcactataggggctttgccacattcttcacatttgtaatgtaacagaggagaacattaatgatgtgaagaaacctggcggcagcgcaaaagatg

SEQ ID NO: 243692 - DNA, 103 bp, Artificial Sequence
  Synthetic Polynucleotide
taatacgactcactatagggccaaatgaaggctttgccacattcttcacaaacagaggagatgtgaaatgtgtggcaaaaacctggcggcagcgcaaaagatg

SEQ ID NO: 243693 - DNA, 103 bp, Artificial Sequence
  Synthetic Polynucleotide
taatacgactcactatagggggactgaggaccaaatgaaggctttgccacaacagaggagagtggcaatgccttcatttaacctggcggcagcgcaaaagatg

SEQ ID NO: 243694 - DNA, 103 bp, Artificial Sequence
  Synthetic Polynucleotide
taatacgactcactatagggtgtctagttaggactgaggaccaaatgaagaacagaggagacttcatatggtcctcagtaacctggcggcagcgcaaaagatg

SEQ ID NO: 243695 - DNA, 103 bp, Artificial Sequence
  Synthetic Polynucleotide
taatacgactcactatagggaactctcttatgtctagttaggactgaggaaacagaggagatcctcaatgctaactagaaacctggcggcagcgcaaaagatg

SEQ ID NO: 243696 - DNA, 103 bp, Artificial Sequence
  Synthetic Polynucleotide
taatacgactcactatagggctccagtatgaactctcttatgtctagttaaacagaggagataactaatgataagagagaacctggcggcagcgcaaaagatg

SEQ ID NO: 243697 - DNA, 103 bp, Artificial Sequence
  Synthetic Polynucleotide
taatacgactcactatagggtagggcttctctccagtatgaactctcttaaacagaggagataagagatgtcatactggaacctggcggcagcgcaaaagatg

SEQ ID NO: 243698 - DNA, 103 bp, Artificial Sequence
  Synthetic Polynucleotide
taatacgactcactatagggttcacatttgtagggcttctctccagtatgaacagaggagacatactatggagaagcccaacctggcggcagcgcaaaagatg

SEQ ID NO: 243699 - DNA, 103 bp, Artificial Sequence
  Synthetic Polynucleotide
taatacgactcactatagggtgccacattcttcacatttgtagggcttctaacagaggagaagaagcatgacaaatgtgaacctggcggcagcgcaaaagatg

SEQ ID NO: 243700 - DNA, 103 bp, Artificial Sequence
  Synthetic Polynucleotide
taatacgactcactatagggacaacaataccaaggaagaccaggttactgaacagaggagacagtaaatgggtcttcctaacctggcggcagcgcaaaagatg

SEQ ID NO: 243701 - DNA, 103 bp, Artificial Sequence
  Synthetic Polynucleotide
taatacgactcactatagggttaaaggctttgccacattcttcacatttgaacagaggagacaaatgatgagaatgtggaacctggcggcagcgcaaaagatg

SEQ ID NO: 243702 - DNA, 103 bp, Artificial Sequence
  Synthetic Polynucleotide
taatacgactcactatagggagaggagtacttaaaggctttgccacattcaacagaggagagaatgtatgaaagcctttaacctggcggcagcgcaaaagatg

SEQ ID NO: 243703 - DNA, 103 bp, Artificial Sequence
  Synthetic Polynucleotide
taatacgactcactatagggaactaagggtagaggagtacttaaaggcttaacagaggagaaagcctatgagtactcctaacctggcggcagcgcaaaagatg

SEQ ID NO: 243704 - DNA, 103 bp, Artificial Sequence
  Synthetic Polynucleotide
taatacgactcactatagggctcttatgtgaactaagggtagaggagtacaacagaggagagtactcatgtacccttagaacctggcggcagcgcaaaagatg

SEQ ID NO: 243705 - DNA, 103 bp, Artificial Sequence
  Synthetic Polynucleotide
taatacgactcactatagggagtatgacttctcttatgtgaactaagggtaacagaggagaacccttatgtcacataagaacctggcggcagcgcaaaagatg

SEQ ID NO: 243706 - DNA, 103 bp, Artificial Sequence
  Synthetic Polynucleotide
taatacgactcactataggggtttctctccagtatgacttctcttatgtgaacagaggagacacataatggaagtcataaacctggcggcagcgcaaaagatg

SEQ ID NO: 243707 - DNA, 103 bp, Artificial Sequence
  Synthetic Polynucleotide
taatacgactcactatagggcatttgtagggtttctctccagtatgacttaacagaggagaaagtcaatgtggagagaaaacctggcggcagcgcaaaagatg

SEQ ID NO: 243708 - DNA, 103 bp, Artificial Sequence
  Synthetic Polynucleotide
taatacgactcactatagggacattcttcacatttgtagggtttctctccaacagaggagaggagagatgccctacaaaaacctggcggcagcgcaaaagatg

SEQ ID NO: 243709 - DNA, 103 bp, Artificial Sequence
  Synthetic Polynucleotide
taatacgactcactatagggaggctttgccacattcttcacatttgtaggaacagaggagacctacaatggtgaagaataacctggcggcagcgcaaaagatg

SEQ ID NO: 243710 - DNA, 103 bp, Artificial Sequence
  Synthetic Polynucleotide
taatacgactcactataggggatgcaacaaaggctttgccacattcttcaaacagaggagatgaagaatgtggcaaagcaacctggcggcagcgcaaaagatg

SEQ ID NO: 243711 - DNA, 103 bp, Artificial Sequence
  Synthetic Polynucleotide
taatacgactcactatagggtggcttagagacaacaataccaaggaagacaacagaggagagtcttcatgggtattgttaacctggcggcagcgcaaaagatg

SEQ ID NO: 243712 - DNA, 103 bp, Artificial Sequence
  Synthetic Polynucleotide
taatacgactcactatagggaagggttgaggatgcaacaaaggctttgccaacagaggagaggcaaaatgtttgttgcaaacctggcggcagcgcaaaagatg

SEQ ID NO: 243713 - DNA, 103 bp, Artificial Sequence
  Synthetic Polynucleotide
taatacgactcactatagggcatgtttactaagggttgaggatgcaacaaaacagaggagattgttgatgcctcaacccaacctggcggcagcgcaaaagatg

SEQ ID NO: 243714 - DNA, 103 bp, Artificial Sequence
  Synthetic Polynucleotide
taatacgactcactatagggtgaatgatctcatgtttactaagggttgagaacagaggagactcaacatgtagtaaacaaacctggcggcagcgcaaaagatg

SEQ ID NO: 243715 - DNA, 103 bp, Artificial Sequence
  Synthetic Polynucleotide
taatacgactcactatagggctttccagtatgaatgatctcatgtttactaacagaggagaagtaaaatggagatcattaacctggcggcagcgcaaaagatg

SEQ ID NO: 243716 - DNA, 103 bp, Artificial Sequence
  Synthetic Polynucleotide
taatacgactcactatagggtgtagggtttctttccagtatgaatgatctaacagaggagaagatcaatgatactggaaaacctggcggcagcgcaaaagatg

SEQ ID NO: 243717 - DNA, 103 bp, Artificial Sequence
  Synthetic Polynucleotide
taatacgactcactatagggtcttcacacttgtagggtttctttccagtaaacagaggagatactggatggaaaccctaaacctggcggcagcgcaaaagatg

SEQ ID NO: 243718 - DNA, 103 bp, Artificial Sequence
  Synthetic Polynucleotide
taatacgactcactatagggtttgccacattcttcacacttgtagggtttaacagaggagaaaacccatgaagtgtgaaaacctggcggcagcgcaaaagatg

SEQ ID NO: 243719 - DNA, 103 bp, Artificial Sequence
  Synthetic Polynucleotide
taatacgactcactatagggggttaaaagctttgccacattcttcacactaacagaggagaagtgtgatgaatgtggcaaacctggcggcagcgcaaaagatg

SEQ ID NO: 243720 - DNA, 103 bp, Artificial Sequence
  Synthetic Polynucleotide
taatacgactcactataggggatgaggactggttaaaagctttgccacataacagaggagaatgtggatgagcttttaaaacctggcggcagcgcaaaagatg

SEQ ID NO: 243721 - DNA, 103 bp, Artificial Sequence
  Synthetic Polynucleotide
taatacgactcactatagggtttagtaagggatgaggactggttaaaagcaacagaggagagcttttatgcagtcctcaaacctggcggcagcgcaaaagatg

SEQ ID NO: 243722 - DNA, 103 bp, Artificial Sequence
  Synthetic Polynucleotide
taatacgactcactatagggcgatcaggtctggcttagagacaacaatacaacagaggagagtattgatgtctctaagcaacctggcggcagcgcaaaagatg

SEQ ID NO: 243723 - DNA, 103 bp, Artificial Sequence
  Synthetic Polynucleotide
taatacgactcactatagggttttcttatgtttagtaagggatgaggactaacagaggagaagtcctatgcccttactaaacctggcggcagcgcaaaagatg

SEQ ID NO: 243724 - DNA, 103 bp, Artificial Sequence
  Synthetic Polynucleotide
taatacgactcactatagggccagtatgaattttcttatgtttagtaaggaacagaggagaccttacatgacataagaaaacctggcggcagcgcaaaagatg

SEQ ID NO: 243725 - DNA, 103 bp, Artificial Sequence
  Synthetic Polynucleotide
taatacgactcactataggggggtttctctccagtatgaattttcttatgaacagaggagacataagatgattcatactaacctggcggcagcgcaaaagatg

SEQ ID NO: 243726 - DNA, 103 bp, Artificial Sequence
  Synthetic Polynucleotide
taatacgactcactatagggcacatttgtagggtttctctccagtatgaaaacagaggagattcataatggagagaaacaacctggcggcagcgcaaaagatg

SEQ ID NO: 243727 - DNA, 103 bp, Artificial Sequence
  Synthetic Polynucleotide
taatacgactcactatagggccacattcttcacatttgtagggtttctctaacagaggagaagagaaatgctacaaatgaacctggcggcagcgcaaaagatg

SEQ ID NO: 243728 - DNA, 103 bp, Artificial Sequence
  Synthetic Polynucleotide
taatacgactcactatagggaaaagctttgccacattcttcacatttgtaaacagaggagatacaaaatggaagaatgtaacctggcggcagcgcaaaagatg

SEQ ID NO: 243729 - DNA, 103 bp, Artificial Sequence
  Synthetic Polynucleotide
taatacgactcactatagggaggactggttaaaagctttgccacattcttaacagaggagaaagaatatggcaaagcttaacctggcggcagcgcaaaagatg

SEQ ID NO: 243730 - DNA, 103 bp, Artificial Sequence
  Synthetic Polynucleotide
taatacgactcactataggggtaagggaagaggactggttaaaagctttgaacagaggagacaaagcatgtaaccagtcaacctggcggcagcgcaaaagatg

SEQ ID NO: 243731 - DNA, 103 bp, Artificial Sequence
  Synthetic Polynucleotide
taatacgactcactatagggcttatgtttagtaagggaagaggactggttaacagaggagaaaccagatgtcttcccttaacctggcggcagcgcaaaagatg

SEQ ID NO: 243732 - DNA, 103 bp, Artificial Sequence
  Synthetic Polynucleotide
taatacgactcactatagggtatgaattttcttatgtttagtaagggaagaacagaggagacttcccatgctaaacataaacctggcggcagcgcaaaagatg

SEQ ID NO: 243733 - DNA, 103 bp, Artificial Sequence
  Synthetic Polynucleotide
taatacgactcactatagggtccagatgggcgatcaggtctggcttagagaacagaggagactctaaatgagacctgataacctggcggcagcgcaaaagatg

SEQ ID NO: 243734 - DNA, 103 bp, Artificial Sequence
  Synthetic Polynucleotide
taatacgactcactatagggttctctccagtatgaattttcttatgtttaaacagaggagataaacaatggaaaattcaaacctggcggcagcgcaaaagatg

SEQ ID NO: 243735 - DNA, 103 bp, Artificial Sequence
  Synthetic Polynucleotide
taatacgactcactatagggtttgtagggtttctctccagtatgaattttaacagaggagaaaaattatgactggagagaacctggcggcagcgcaaaagatg

SEQ ID NO: 243736 - DNA, 103 bp, Artificial Sequence
  Synthetic Polynucleotide
taatacgactcactatagggattcttcacatttgtagggtttctctccagaacagaggagactggagatgaaccctacaaacctggcggcagcgcaaaagatg

SEQ ID NO: 243737 - DNA, 103 bp, Artificial Sequence
  Synthetic Polynucleotide
taatacgactcactataggggctttgccacattcttcacatttgtagggtaacagaggagaaccctaatgatgtgaagaaacctggcggcagcgcaaaagatg

SEQ ID NO: 243738 - DNA, 103 bp, Artificial Sequence
  Synthetic Polynucleotide
taatacgactcactatagggctggttaaaagctttgccacattcttcacaaacagaggagatgtgaaatgtgtggcaaaaacctggcggcagcgcaaaagatg

SEQ ID NO: 243739 - DNA, 103 bp, Artificial Sequence
  Synthetic Polynucleotide
taatacgactcactataggggggttgaggactggttaaaagctttgccacaacagaggagagtggcaatgcttttaaccaacctggcggcagcgcaaaagatg

SEQ ID NO: 243740 - DNA, 103 bp, Artificial Sequence
  Synthetic Polynucleotide
taatacgactcactatagggtgtttaataagggttgaggactggttaaaaaacagaggagattttaaatggtcctcaacaacctggcggcagcgcaaaagatg

SEQ ID NO: 243741 - DNA, 103 bp, Artificial Sequence
  Synthetic Polynucleotide
taatacgactcactatagggaattttcttatgtttaataagggttgaggaaacagaggagatcctcaatgcttattaaaaacctggcggcagcgcaaaagatg

SEQ ID NO: 243742 - DNA, 103 bp, Artificial Sequence
  Synthetic Polynucleotide
taatacgactcactatagggctctagtatgaattttcttatgtttaataaaacagaggagattattaatgataagaaaaaacctggcggcagcgcaaaagatg

SEQ ID NO: 243743 - DNA, 103 bp, Artificial Sequence
  Synthetic Polynucleotide
taatacgactcactatagggtagggtttctctctagtatgaattttcttaaacagaggagataagaaatgtcatactagaacctggcggcagcgcaaaagatg

SEQ ID NO: 243744 - DNA, 103 bp, Artificial Sequence
  Synthetic Polynucleotide
taatacgactcactatagggttttccttgctccagatgggcgatcaggtcaacagaggagagacctgatggcccatctgaacctggcggcagcgcaaaagatg

SEQ ID NO: 243745 - DNA, 103 bp, Artificial Sequence
  Synthetic Polynucleotide
taatacgactcactatagggttcacatttgtagggtttctctctagtatgaacagaggagacatactatggagaaacccaacctggcggcagcgcaaaagatg

SEQ ID NO: 243746 - DNA, 103 bp, Artificial Sequence
  Synthetic Polynucleotide
taatacgactcactatagggtgccacattcttcacatttgtagggtttctaacagaggagaagaaacatgacaaatgtgaacctggcggcagcgcaaaagatg

SEQ ID NO: 243747 - DNA, 103 bp, Artificial Sequence
  Synthetic Polynucleotide
taatacgactcactatagggtgaaaagctttgccacattcttcacatttgaacagaggagacaaatgatgagaatgtggaacctggcggcagcgcaaaagatg

SEQ ID NO: 243748 - DNA, 103 bp, Artificial Sequence
  Synthetic Polynucleotide
taatacgactcactatagggtgtggataggtgaaaagctttgccacattcaacagaggagagaatgtatgaaagcttttaacctggcggcagcgcaaaagatg

SEQ ID NO: 243749 - DNA, 103 bp, Artificial Sequence
  Synthetic Polynucleotide
taatacgactcactatagggtagtaaggtgtgtggataggtgaaaagcttaacagaggagaaagcttatgacctatccaaacctggcggcagcgcaaaagatg

SEQ ID NO: 243750 - DNA, 103 bp, Artificial Sequence
  Synthetic Polynucleotide
taatacgactcactatagggatcttatgtgtagtaaggtgtgtggataggaacagaggagacctatcatgacaccttacaacctggcggcagcgcaaaagatg

SEQ ID NO: 243751 - DNA, 103 bp, Artificial Sequence
  Synthetic Polynucleotide
taatacgactcactatagggagtatgaagtatcttatgtgtagtaaggtgaacagaggagacaccttatgacacataagaacctggcggcagcgcaaaagatg

SEQ ID NO: 243752 - DNA, 103 bp, Artificial Sequence
  Synthetic Polynucleotide
taatacgactcactataggggtttctctccagtatgaagtatcttatgtgaacagaggagacacataatgtacttcataaacctggcggcagcgcaaaagatg

SEQ ID NO: 243753 - DNA, 103 bp, Artificial Sequence
  Synthetic Polynucleotide
taatacgactcactatagggcatctataaggtttctctccagtatgaagtaacagaggagaacttcaatgtggagagaaaacctggcggcagcgcaaaagatg

SEQ ID NO: 243754 - DNA, 103 bp, Artificial Sequence
  Synthetic Polynucleotide
taatacgactcactatagggacattctctacatctataaggtttctctccaacagaggagaggagagatgccttatagaaacctggcggcagcgcaaaagatg

SEQ ID NO: 243755 - DNA, 103 bp, Artificial Sequence
  Synthetic Polynucleotide
taatacgactcactatagggtcaaaggtttttttccttgctccagatgggaacagaggagacccatcatgagcaaggaaaacctggcggcagcgcaaaagatg

SEQ ID NO: 243756 - DNA, 103 bp, Artificial Sequence
  Synthetic Polynucleotide
taatacgactcactatagggaagctttgccacattctctacatctataagaacagaggagacttataatggtagagaataacctggcggcagcgcaaaagatg

SEQ ID NO: 243757 - DNA, 103 bp, Artificial Sequence
  Synthetic Polynucleotide
taatacgactcactataggggaatggttaaaagctttgccacattctctaaacagaggagatagagaatgtggcaaagcaacctggcggcagcgcaaaagatg

SEQ ID NO: 243758 - DNA, 103 bp, Artificial Sequence
  Synthetic Polynucleotide
taatacgactcactatagggaagggttgcagaatggttaaaagctttgccaacagaggagaggcaaaatgtttaaccataacctggcggcagcgcaaaagatg

SEQ ID NO: 243759 - DNA, 103 bp, Artificial Sequence
  Synthetic Polynucleotide
taatacgactcactatagggtatgtgaagaaagggttgcagaatggttaaaacagaggagattaaccatgctgcaacccaacctggcggcagcgcaaaagatg

SEQ ID NO: 243760 - DNA, 103 bp, Artificial Sequence
  Synthetic Polynucleotide
taatacgactcactatagggtggattttcttatgtgaagaaagggttgcaaacagaggagatgcaacatgttcttcacaaacctggcggcagcgcaaaagatg

SEQ ID NO: 243761 - DNA, 103 bp, Artificial Sequence
  Synthetic Polynucleotide
taatacgactcactatagggctctccagaatggattttcttatgtgaagaaacagaggagatcttcaatgaagaaaatcaacctggcggcagcgcaaaagatg

SEQ ID NO: 243762 - DNA, 103 bp, Artificial Sequence
  Synthetic Polynucleotide
taatacgactcactatagggcgtatggtttctctccagaatggattttctaacagaggagaagaaaaatgattctggagaacctggcggcagcgcaaaagatg

SEQ ID NO: 243763 - DNA, 103 bp, Artificial Sequence
  Synthetic Polynucleotide
taatacgactcactatagggttatcacactcgtatggtttctctccagaaaacagaggagattctggatggaaaccataaacctggcggcagcgcaaaagatg

SEQ ID NO: 243764 - DNA, 103 bp, Artificial Sequence
  Synthetic Polynucleotide
taatacgactcactatagggtttgccacatttatcacactcgtatggtttaacagaggagaaaaccaatggagtgtgataacctggcggcagcgcaaaagatg

SEQ ID NO: 243765 - DNA, 103 bp, Artificial Sequence
  Synthetic Polynucleotide
taatacgactcactatagggaaataaaggctttgccacatttatcacactaacagaggagaagtgtgatgaatgtggcaaacctggcggcagcgcaaaagatg

SEQ ID NO: 243766 - DNA, 103 bp, Artificial Sequence
  Synthetic Polynucleotide
taatacgactcactatagggctcttcatagtcaaaggtttttttccttgcaacagaggagagcaaggatgaaaacctttaacctggcggcagcgcaaaagatg

SEQ ID NO: 243767 - DNA, 103 bp, Artificial Sequence
  Synthetic Polynucleotide
taatacgactcactatagggcttgagggtgaaataaaggctttgccacataacagaggagaatgtggatgagcctttataacctggcggcagcgcaaaagatg

SEQ ID NO: 243768 - DNA, 103 bp, Artificial Sequence
  Synthetic Polynucleotide
taatacgactcactatagggtctactaaggcttgagggtgaaataaaggcaacagaggagagcctttatgtcaccctcaaacctggcggcagcgcaaaagatg

SEQ ID NO: 243769 - DNA, 103 bp, Artificial Sequence
  Synthetic Polynucleotide
taatacgactcactatagggttatctcatgtctactaaggcttgagggtgaacagaggagacaccctatggccttagtaaacctggcggcagcgcaaaagatg

SEQ ID NO: 243770 - DNA, 103 bp, Artificial Sequence
  Synthetic Polynucleotide
taatacgactcactatagggccagtatgaattatctcatgtctactaaggaacagaggagaccttagatgacatgagataacctggcggcagcgcaaaagatg

SEQ ID NO: 243771 - DNA, 103 bp, Artificial Sequence
  Synthetic Polynucleotide
taatacgactcactataggggggtttctccccagtatgaattatctcatgaacagaggagacatgagatgattcatactaacctggcggcagcgcaaaagatg

SEQ ID NO: 243772 - DNA, 103 bp, Artificial Sequence
  Synthetic Polynucleotide
taatacgactcactatagggcatctcatgtctcttcatagtcaaaggtttaacagaggagaaaacctatgactatgaagaacctggcggcagcgcaaaagatg

SEQ ID NO: 243773 - DNA, 103 bp, Artificial Sequence
  Synthetic Polynucleotide
taatacgactcactatagggagaattctatggccacatctctaaattgcaaacagaggagatgcaatatggagatgtggaacctggcggcagcgcaaaagatg

SEQ ID NO: 243774 - DNA, 103 bp, Artificial Sequence
  Synthetic Polynucleotide
taatacgactcactatagggggttggctaccatctcatgtctcttcatagaacagaggagactatgaatggacatgagaaacctggcggcagcgcaaaagatg

SEQ ID NO: 243775 - DNA, 103 bp, Artificial Sequence
  Synthetic Polynucleotide
taatacgactcactatagggataactgaggggttggctaccatctcatgtaacagaggagaacatgaatgggtagccaaaacctggcggcagcgcaaaagatg

SEQ ID NO: 243776 - DNA, 103 bp, Artificial Sequence
  Synthetic Polynucleotide
taatacgactcactatagggatgagaacatataactgaggggttggctacaacagaggagagtagccatgccctcagttaacctggcggcagcgcaaaagatg

SEQ ID NO: 243777 - DNA, 103 bp, Artificial Sequence
  Synthetic Polynucleotide
taatacgactcactatagggcttgggcaaaatgagaacatataactgaggaacagaggagacctcagatgtatgttctcaacctggcggcagcgcaaaagatg

SEQ ID NO: 243778 - DNA, 103 bp, Artificial Sequence
  Synthetic Polynucleotide
taatacgactcactatagggggccaaagatcttgggcaaaatgagaacataacagaggagaatgttcatgttttgcccaaacctggcggcagcgcaaaagatg

SEQ ID NO: 243779 - DNA, 103 bp, Artificial Sequence
  Synthetic Polynucleotide
taatacgactcactataggggttctgctctggccaaagatcttgggcaaaaacagaggagatttgccatggatctttggaacctggcggcagcgcaaaagatg

SEQ ID NO: 243780 - DNA, 103 bp, Artificial Sequence
  Synthetic Polynucleotide
taatacgactcactatagggaatcttttatgttctgctctggccaaagataacagaggagaatctttatgcagagcagaaacctggcggcagcgcaaaagatg

SEQ ID NO: 243781 - DNA, 103 bp, Artificial Sequence
  Synthetic Polynucleotide
taatacgactcactatagggttttggaaagaatcttttatgttctgctctaacagaggagaagagcaatgcataaaagaaacctggcggcagcgcaaaagatg

SEQ ID NO: 243782 - DNA, 103 bp, Artificial Sequence
  Synthetic Polynucleotide
taatacgactcactatagggcagtatcactttttggaaagaatcttttataacagaggagaataaaaatgtctttccaaaacctggcggcagcgcaaaagatg

SEQ ID NO: 243783 - DNA, 103 bp, Artificial Sequence
  Synthetic Polynucleotide
taatacgactcactatagggcatatcttctcagtatcactttttggaaagaacagaggagactttccatgaagtgatacaacctggcggcagcgcaaaagatg

SEQ ID NO: 243784 - DNA, 103 bp, Artificial Sequence
  Synthetic Polynucleotide
taatacgactcactatagggtcctccagagagaattctatggccacatctaacagaggagaagatgtatgcatagaattaacctggcggcagcgcaaaagatg

SEQ ID NO: 243785 - DNA, 103 bp, Artificial Sequence
  Synthetic Polynucleotide
taatacgactcactatagggccacgtttttcatatcttctcagtatcactaacagaggagaagtgatatggagaagataaacctggcggcagcgcaaaagatg

SEQ ID NO: 243786 - DNA, 103 bp, Artificial Sequence
  Synthetic Polynucleotide
taatacgactcactatagggatttccatgtccacgtttttcatatcttctaacagaggagaagaagaatggaaaaacgtaacctggcggcagcgcaaaagatg

SEQ ID NO: 243787 - DNA, 103 bp, Artificial Sequence
  Synthetic Polynucleotide
taatacgactcactatagggttaactgtaaatttccatgtccacgtttttaacagaggagaaaaaacatggacatggaaaacctggcggcagcgcaaaagatg

SEQ ID NO: 243788 - DNA, 103 bp, Artificial Sequence
  Synthetic Polynucleotide
taatacgactcactatagggcacctttttattaactgtaaatttccatgtaacagaggagaacatggatgtttacagttaacctggcggcagcgcaaaagatg

SEQ ID NO: 243789 - DNA, 103 bp, Artificial Sequence
  Synthetic Polynucleotide
taatacgactcactatagggtacactttcacacctttttattaactgtaaaacagaggagattacagatgataaaaaggaacctggcggcagcgcaaaagatg

SEQ ID NO: 243790 - DNA, 103 bp, Artificial Sequence
  Synthetic Polynucleotide
taatacgactcactatagggtacactcatctacactttcacacctttttaaacagaggagataaaaaatggtgaaagtgaacctggcggcagcgcaaaagatg

SEQ ID NO: 243791 - DNA, 103 bp, Artificial Sequence
  Synthetic Polynucleotide
taatacgactcactataggggtgtgcaccttacactcatctacactttcaaacagaggagatgaaagatgagatgagtgaacctggcggcagcgcaaaagatg

SEQ ID NO: 243792 - DNA, 103 bp, Artificial Sequence
  Synthetic Polynucleotide
taatacgactcactatagggataacctcctgtgtgcaccttacactcatcaacagaggagagatgagatgaaggtgcacaacctggcggcagcgcaaaagatg

SEQ ID NO: 243793 - DNA, 103 bp, Artificial Sequence
  Synthetic Polynucleotide
taatacgactcactatagggtaagtccattataacctcctgtgtgcacctaacagaggagaaggtgcatgcaggaggttaacctggcggcagcgcaaaagatg

SEQ ID NO: 243794 - DNA, 103 bp, Artificial Sequence
  Synthetic Polynucleotide
taatacgactcactatagggctacactggttaagtccattataacctcctaacagaggagaaggaggatgtaatggactaacctggcggcagcgcaaaagatg

SEQ ID NO: 243795 - DNA, 103 bp, Artificial Sequence
  Synthetic Polynucleotide
taatacgactcactataggggcaatgccactcctccagagagaattctataacagaggagaatagaaatgtctctggagaacctggcggcagcgcaaaagatg

SEQ ID NO: 243796 - DNA, 103 bp, Artificial Sequence
  Synthetic Polynucleotide
taatacgactcactatagggggtagttgtactacactggttaagtccattaacagaggagaaatggaatgaaccagtgtaacctggcggcagcgcaaaagatg

SEQ ID NO: 243797 - DNA, 103 bp, Artificial Sequence
  Synthetic Polynucleotide
taatacgactcactatagggctttgctctgggtagttgtactacactggtaacagaggagaaccagtatggtacaactaaacctggcggcagcgcaaaagatg

SEQ ID NO: 243798 - DNA, 103 bp, Artificial Sequence
  Synthetic Polynucleotide
taatacgactcactatagggcattgaaatactttgctctgggtagttgtaaacagaggagatacaacatgccagagcaaaacctggcggcagcgcaaaagatg

SEQ ID NO: 243799 - DNA, 103 bp, Artificial Sequence
  Synthetic Polynucleotide
taatacgactcactatagggatatttatcacattgaaatactttgctctgaacagaggagacagagcatggtatttcaaaacctggcggcagcgcaaaagatg

SEQ ID NO: 243800 - DNA, 103 bp, Artificial Sequence
  Synthetic Polynucleotide
taatacgactcactatagggagactttcccatatttatcacattgaaataaacagaggagatatttcatggtgataaataacctggcggcagcgcaaaagatg

SEQ ID NO: 243801 - DNA, 103 bp, Artificial Sequence
  Synthetic Polynucleotide
taatacgactcactatagggaatttatgaaagactttcccatatttatcaaacagaggagatgataaatgtgggaaagtaacctggcggcagcgcaaaagatg

SEQ ID NO: 243802 - DNA, 103 bp, Artificial Sequence
  Synthetic Polynucleotide
taatacgactcactatagggtgaatttgaaaatttatgaaagactttcccaacagaggagagggaaaatgtttcataaaaacctggcggcagcgcaaaagatg

SEQ ID NO: 243803 - DNA, 103 bp, Artificial Sequence
  Synthetic Polynucleotide
taatacgactcactatagggtatgtctatttgaatttgaaaatttatgaaaacagaggagattcataatgtttcaaattaacctggcggcagcgcaaaagatg

SEQ ID NO: 243804 - DNA, 103 bp, Artificial Sequence
  Synthetic Polynucleotide
taatacgactcactatagggtgtcttatattatgtctatttgaatttgaaaacagaggagattcaaaatgaaatagacaaacctggcggcagcgcaaaagatg

SEQ ID NO: 243805 - DNA, 103 bp, Artificial Sequence
  Synthetic Polynucleotide
taatacgactcactatagggtttttcagtatgtcttatattatgtctattaacagaggagaaatagaatgaatataagaaacctggcggcagcgcaaaagatg

SEQ ID NO: 243806 - DNA, 103 bp, Artificial Sequence
  Synthetic Polynucleotide
taatacgactcactatagggcagtgtccaggcaatgccactcctccagagaacagaggagactctggatgagtggcattaacctggcggcagcgcaaaagatg

SEQ ID NO: 243807 - DNA, 103 bp, Artificial Sequence
  Synthetic Polynucleotide
taatacgactcactatagggtgaaaggttttttttcagtatgtcttatataacagaggagaatataaatgatactgaaaaacctggcggcagcgcaaaagatg

SEQ ID NO: 243808 - DNA, 103 bp, Artificial Sequence
  Synthetic Polynucleotide
taatacgactcactatagggtctatgcatttgaaaggttttttttcagtaaacagaggagatactgaatgaaaacctttaacctggcggcagcgcaaaagatg

SEQ ID NO: 243809 - DNA, 103 bp, Artificial Sequence
  Synthetic Polynucleotide
taatacgactcactatagggtttgccacattctatgcatttgaaaggtttaacagaggagaaaacctatgaaatgcataaacctggcggcagcgcaaaagatg

SEQ ID NO: 243810 - DNA, 103 bp, Artificial Sequence
  Synthetic Polynucleotide
taatacgactcactatagggggttaaaagctttgccacattctatgcattaacagaggagaaatgcaatgaatgtggcaaacctggcggcagcgcaaaagatg

SEQ ID NO: 243811 - DNA, 103 bp, Artificial Sequence
  Synthetic Polynucleotide
taatacgactcactataggggttgagaactggttaaaagctttgccacataacagaggagaatgtggatgagcttttaaaacctggcggcagcgcaaaagatg

SEQ ID NO: 243812 - DNA, 103 bp, Artificial Sequence
  Synthetic Polynucleotide
taatacgactcactatagggtgttataagggttgagaactggttaaaagcaacagaggagagcttttatgcagttctcaaacctggcggcagcgcaaaagatg

SEQ ID NO: 243813 - DNA, 103 bp, Artificial Sequence
  Synthetic Polynucleotide
taatacgactcactatagggttttcttatgtgttataagggttgagaactaacagaggagaagttctatgcccttataaaacctggcggcagcgcaaaagatg

SEQ ID NO: 243814 - DNA, 103 bp, Artificial Sequence
  Synthetic Polynucleotide
taatacgactcactatagggccagtatgaattttcttatgtgttataaggaacagaggagaccttatatgacataagaaaacctggcggcagcgcaaaagatg

SEQ ID NO: 243815 - DNA, 103 bp, Artificial Sequence; identical to SEQ ID NO: 243725
  Synthetic Polynucleotide

SEQ ID NO: 243816 - DNA, 103 bp, Artificial Sequence
  Synthetic Polynucleotide
taatacgactcactatagggcacaaatgtagggtttctctccagtatgaaaacagaggagattcataatggagagaaacaacctggcggcagcgcaaaagatg

SEQ ID NO: 243817 - DNA, 103 bp, Artificial Sequence
  Synthetic Polynucleotide
taatacgactcactatagggttccgctgtgcagtgtccaggcaatgccacaacagaggagagtggcaatgcctggacacaacctggcggcagcgcaaaagatg

SEQ ID NO: 243818 - DNA, 103 bp, Artificial Sequence
  Synthetic Polynucleotide
taatacgactcactatagggccacattcttcacaaatgtagggtttctctaacagaggagaagagaaatgctacatttgaacctggcggcagcgcaaaagatg

SEQ ID NO: 243819 - DNA, 103 bp, Artificial Sequence
  Synthetic Polynucleotide
taatacgactcactatagggaaaggctttgccacattcttcacaaatgtaaacagaggagatacattatggaagaatgtaacctggcggcagcgcaaaagatg

SEQ ID NO: 243820 - DNA, 103 bp, Artificial Sequence
  Synthetic Polynucleotide
taatacgactcactatagggaggagtacttaaaggctttgccacattcttaacagaggagaaagaatatggcaaagcctaacctggcggcagcgcaaaagatg

SEQ ID NO: 243821 - DNA, 103 bp, Artificial Sequence
  Synthetic Polynucleotide
taatacgactcactatagggttaagggcagaggagtacttaaaggctttgaacagaggagacaaagcatgtaagtactcaacctggcggcagcgcaaaagatg

SEQ ID NO: 243822 - DNA, 103 bp, Artificial Sequence
  Synthetic Polynucleotide
taatacgactcactatagggcttatgtgtattaagggcagaggagtacttaacagaggagaaagtacatgtctgcccttaacctggcggcagcgcaaaagatg

SEQ ID NO: 243823 - DNA, 103 bp, Artificial Sequence
  Synthetic Polynucleotide
taatacgactcactatagggtatgaattctcttatgtgtattaagggcagaacagaggagactgcccatgatacacataaacctggcggcagcgcaaaagatg

SEQ ID NO: 243824 - DNA, 103 bp, Artificial Sequence
  Synthetic Polynucleotide
taatacgactcactatagggttctctccagtatgaattctcttatgtgtaaacagaggagatacacaatggagaattcaaacctggcggcagcgcaaaagatg

SEQ ID NO: 243825 - DNA, 103 bp, Artificial Sequence
  Synthetic Polynucleotide
taatacgactcactatagggcttgtatggtttctctccagtatgaattctaacagaggagaagaattatgactggagagaacctggcggcagcgcaaaagatg

SEQ ID NO: 243826 - DNA, 103 bp, Artificial Sequence
  Synthetic Polynucleotide
taatacgactcactatagggatttatcacacttgtatggtttctctccagaacagaggagactggagatgaaccatacaaacctggcggcagcgcaaaagatg

SEQ ID NO: 243827 - DNA, 103 bp, Artificial Sequence
  Synthetic Polynucleotide
taatacgactcactataggggctttgtcacatttatcacacttgtatggtaacagaggagaaccataatggtgtgataaaacctggcggcagcgcaaaagatg

SEQ ID NO: 243828 - DNA, 103 bp, Artificial Sequence
  Synthetic Polynucleotide
taatacgactcactatagggcctatatagattccgctgtgcagtgtccagaacagaggagactggacatggcacagcggaacctggcggcagcgcaaaagatg

SEQ ID NO: 243829 - DNA, 103 bp, Artificial Sequence
  Synthetic Polynucleotide
taatacgactcactatagggtgcaataaaggctttgtcacatttatcacaaacagaggagatgtgatatgtgtgacaaaaacctggcggcagcgcaaaagatg

SEQ ID NO: 243830 - DNA, 103 bp, Artificial Sequence
  Synthetic Polynucleotide
taatacgactcactataggggggttgaggatgcaataaaggctttgtcacaacagaggagagtgacaatgcctttattgaacctggcggcagcgcaaaagatg

SEQ ID NO: 243831 - DNA, 103 bp, Artificial Sequence
  Synthetic Polynucleotide
taatacgactcactatagggtgtttactaagggttgaggatgcaataaagaacagaggagactttatatgatcctcaacaacctggcggcagcgcaaaagatg

SEQ ID NO: 243832 - DNA, 103 bp, Artificial Sequence
  Synthetic Polynucleotide
taatacgactcactatagggaatgatctcatgtttactaagggttgaggaaacagaggagatcctcaatgcttagtaaaaacctggcggcagcgcaaaagatg

SEQ ID NO: 243833 - DNA, 103 bp, Artificial Sequence
  Synthetic Polynucleotide
taatacgactcactatagggttccagtatgaatgatctcatgtttactaaaacagaggagattagtaatgatgagatcaaacctggcggcagcgcaaaagatg

SEQ ID NO: 243834 - DNA, 103 bp, Artificial Sequence
  Synthetic Polynucleotide
taatacgactcactatagggtagggtttctttccagtatgaatgatctcaaacagaggagatgagatatgtcatactggaacctggcggcagcgcaaaagatg

SEQ ID NO: 243835 - DNA, 103 bp, Artificial Sequence
  Synthetic Polynucleotide
taatacgactcactatagggttcacacttgtagggtttctttccagtatgaacagaggagacatactatgaagaaacccaacctggcggcagcgcaaaagatg

SEQ ID NO: 243836 - DNA, 103 bp, Artificial Sequence
  Synthetic Polynucleotide
taatacgactcactatagggtgccacattcttcacacttgtagggtttctaacagaggagaagaaacatgacaagtgtgaacctggcggcagcgcaaaagatg

SEQ ID NO: 243837 - DNA, 103 bp, Artificial Sequence
  Synthetic Polynucleotide
taatacgactcactatagggttaaaagctttgccacattcttcacacttgaacagaggagacaagtgatgagaatgtggaacctggcggcagcgcaaaagatg

SEQ ID NO: 243838 - DNA, 103 bp, Artificial Sequence
  Synthetic Polynucleotide
taatacgactcactatagggcgaggattggttaaaagctttgccacattcaacagaggagagaatgtatgaaagcttttaacctggcggcagcgcaaaagatg

SEQ ID NO: 243839 - DNA, 103 bp, Artificial Sequence
  Synthetic Polynucleotide
taatacgactcactatagggacatcacattcctatatagattccgctgtgaacagaggagacacagcatgatctatataaacctggcggcagcgcaaaagatg

SEQ ID NO: 243840 - DNA, 103 bp, Artificial Sequence
  Synthetic Polynucleotide
taatacgactcactatagggtagtaagtgtcgaggattggttaaaagcttaacagaggagaaagcttatgaccaatcctaacctggcggcagcgcaaaagatg

SEQ ID NO: 243841 - DNA, 103 bp, Artificial Sequence
  Synthetic Polynucleotide
taatacgactcactatagggttcttatgtttagtaagtgtcgaggattggaacagaggagaccaatcatggacacttacaacctggcggcagcgcaaaagatg

SEQ ID NO: 243842 - DNA, 103 bp, Artificial Sequence
  Synthetic Polynucleotide
taatacgactcactatagggagtatgaattttcttatgtttagtaagtgtaacagaggagaacacttatgaaacataagaacctggcggcagcgcaaaagatg

SEQ ID NO: 243843 - DNA, 103 bp, Artificial Sequence
  Synthetic Polynucleotide
taatacgactcactataggggtttctctccagtatgaattttcttatgttaacagaggagaaacataatgaaattcataaacctggcggcagcgcaaaagatg

SEQ ID NO: 243844 - DNA, 103 bp, Artificial Sequence
  Synthetic Polynucleotide
taatacgactcactatagggcatttgtagggtttctctccagtatgaattaacagaggagaaattcaatgtggagagaaaacctggcggcagcgcaaaagatg

SEQ ID NO: 243845 - DNA, 103 bp, Artificial Sequence; identical to SEQ ID NO: 243708
  Synthetic Polynucleotide

SEQ ID NO: 243846 - DNA, 103 bp, Artificial Sequence
  Synthetic Polynucleotide
taatacgactcactatagggaagctttgccacattcttcacatttgtaggaacagaggagacctacaatggtgaagaataacctggcggcagcgcaaaagatg

SEQ ID NO: 243847 - DNA, 103 bp, Artificial Sequence
  Synthetic Polynucleotide
taatacgactcactataggggattggttaaaagctttgccacattcttcaaacagaggagatgaagaatgtggcaaagcaacctggcggcagcgcaaaagatg

SEQ ID NO: 243848 - DNA, 103 bp, Artificial Sequence
  Synthetic Polynucleotide
taatacgactcactatagggaagtgttgaggattggttaaaagctttgccaacagaggagaggcaaaatgtttaaccaaaacctggcggcagcgcaaaagatg

SEQ ID NO: 243849 - DNA, 103 bp, Artificial Sequence
  Synthetic Polynucleotide
taatacgactcactatagggtatgtttagtaagtgttgaggattggttaaaacagaggagattaaccatgcctcaacacaacctggcggcagcgcaaaagatg

SEQ ID NO: 243850 - DNA, 103 bp, Artificial Sequence
  Synthetic Polynucleotide
taatacgactcactatagggtagttctctaacatcacattcctatatagaaacagaggagatctataatggaatgtgataacctggcggcagcgcaaaagatg

SEQ ID NO: 243851 - DNA, 103 bp, Artificial Sequence
  Synthetic Polynucleotide
taatacgactcactatagggtgaattttcttatgtttagtaagtgttgagaacagaggagactcaacatgtactaaacaaacctggcggcagcgcaaaagatg

SEQ ID NO: 243852 - DNA, 103 bp, Artificial Sequence
  Synthetic Polynucleotide
taatacgactcactatagggctctccagtatgaattttcttatgtttagtaacagaggagaactaaaatgaagaaaattaacctggcggcagcgcaaaagatg

SEQ ID NO: 243853 - DNA, 103 bp, Artificial Sequence
  Synthetic Polynucleotide
taatacgactcactatagggcgtagggcttctctccagtatgaattttctaacagaggagaagaaaaatgatactggagaacctggcggcagcgcaaaagatg

SEQ ID NO: 243854 - DNA, 103 bp, Artificial Sequence
  Synthetic Polynucleotide
taatacgactcactatagggtcttcacaaacgtagggcttctctccagtaaacagaggagatactggatggaagccctaaacctggcggcagcgcaaaagatg

SEQ ID NO: 243855 - DNA, 103 bp, Artificial Sequence
  Synthetic Polynucleotide
taatacgactcactatagggtttgccacattcttcacaaacgtagggcttaacagaggagaaagcccatggtttgtgaaaacctggcggcagcgcaaaagatg

SEQ ID NO: 243856 - DNA, 103 bp, Artificial Sequence
  Synthetic Polynucleotide
taatacgactcactatagggacttaaaggctttgccacattcttcacaaaaacagaggagatttgtgatgaatgtggcaaacctggcggcagcgcaaaagatg

SEQ ID NO: 243857 - DNA, 103 bp, Artificial Sequence
  Synthetic Polynucleotide
taatacgactcactatagggatacgggagtacttaaaggctttgccacataacagaggagaatgtggatgagcctttaaaacctggcggcagcgcaaaagatg

SEQ ID NO: 243858 - DNA, 103 bp, Artificial Sequence
  Synthetic Polynucleotide
taatacgactcactatagggtgtagtaaggatacgggagtacttaaaggcaacagaggagagcctttatgtactcccgtaacctggcggcagcgcaaaagatg

SEQ ID NO: 243859 - DNA, 103 bp, Artificial Sequence
  Synthetic Polynucleotide
taatacgactcactatagggttctcttatgtgtagtaaggatacgggagtaacagaggagaactcccatgtccttactaaacctggcggcagcgcaaaagatg

SEQ ID NO: 243860 - DNA, 103 bp, Artificial Sequence
  Synthetic Polynucleotide
taatacgactcactatagggccagtatgaattctcttatgtgtagtaaggaacagaggagaccttacatgacataagagaacctggcggcagcgcaaaagatg

SEQ ID NO: 243861 - DNA, 103 bp, Artificial Sequence
  Synthetic Polynucleotide
taatacgactcactatagggtggggccatgcctagtaccttggtcatcataacagaggagaatgatgatgaaggtactaaacctggcggcagcgcaaaagatg

SEQ ID NO: 243862 - DNA, 103 bp, Artificial Sequence
  Synthetic Polynucleotide
taatacgactcactataggggctaggaaggtacttgcctttctcttctttaacagaggagaaaagaaatgaaaggcaagaacctggcggcagcgcaaaagatg

SEQ ID NO: 243863 - DNA, 103 bp, Artificial Sequence
  Synthetic Polynucleotide
taatacgactcactatagggagcttttccacacttacagtcatagggccgaacagaggagacggcccatggactgtaagaacctggcggcagcgcaaaagatg

SEQ ID NO: 243864 - DNA, 103 bp, Artificial Sequence
  Synthetic Polynucleotide
taatacgactcactatagggtctgcccaaaagcttttccacacttacagtaacagaggagaactgtaatggtggaaaagaacctggcggcagcgcaaaagatg

SEQ ID NO: 243865 - DNA, 103 bp, Artificial Sequence
  Synthetic Polynucleotide
taatacgactcactatagggaggtctgagctctgcccaaaagcttttccaaacagaggagatggaaaatgttttgggcaaacctggcggcagcgcaaaagatg

SEQ ID NO: 243866 - DNA, 103 bp, Artificial Sequence
  Synthetic Polynucleotide
taatacgactcactatagggatgtttaagaaggtctgagctctgcccaaaaacagaggagatttgggatgagctcagacaacctggcggcagcgcaaaagatg

SEQ ID NO: 243867 - DNA, 103 bp, Artificial Sequence
  Synthetic Polynucleotide
taatacgactcactataggggcattctctgatgtttaagaaggtctgagcaacagaggagagctcagatgttcttaaacaacctggcggcagcgcaaaagatg

SEQ ID NO: 243868 - DNA, 103 bp, Artificial Sequence
  Synthetic Polynucleotide
taatacgactcactatagggtcttctgtgtgcattctctgatgtttaagaaacagaggagatcttaaatgtcagagaataacctggcggcagcgcaaaagatg

SEQ ID NO: 243869 - DNA, 103 bp, Artificial Sequence
  Synthetic Polynucleotide
taatacgactcactatagggatatggcgcctcttctgtgtgcattctctgaacagaggagacagagaatgcacacagaaaacctggcggcagcgcaaaagatg

SEQ ID NO: 243870 - DNA, 103 bp, Artificial Sequence
  Synthetic Polynucleotide
taatacgactcactatagggctttgcactgatatggcgcctcttctgtgtaacagaggagaacacagatgaggcgccataacctggcggcagcgcaaaagatg

SEQ ID NO: 243871 - DNA, 103 bp, Artificial Sequence
  Synthetic Polynucleotide
taatacgactcactatagggttgccacaatctttgcactgatatggcgccaacagaggagaggcgccatgtcagtgcaaaacctggcggcagcgcaaaagatg

SEQ ID NO: 243872 - DNA, 103 bp, Artificial Sequence
  Synthetic Polynucleotide
taatacgactcactataggggctgaaagccttgccacaatctttgcactgaacagaggagacagtgcatggattgtggcaacctggcggcagcgcaaaagatg

SEQ ID NO: 243873 - DNA, 103 bp, Artificial Sequence
  Synthetic Polynucleotide
taatacgactcactatagggacatctccaggctaggaaggtacttgccttaacagaggagaaaggcaatgaccttcctaaacctggcggcagcgcaaaagatg

SEQ ID NO: 243874 - DNA, 103 bp, Artificial Sequence
  Synthetic Polynucleotide
taatacgactcactatagggtgcctttcccgctgaaagccttgccacaataacagaggagaattgtgatgaggctttcaaacctggcggcagcgcaaaagatg

SEQ ID NO: 243875 - DNA, 103 bp, Artificial Sequence
  Synthetic Polynucleotide
taatacgactcactatagggcgaatgaggctgcctttcccgctgaaagccaacagaggagaggctttatgcgggaaaggaacctggcggcagcgcaaaagatg

SEQ ID NO: 243876 - DNA, 103 bp, Artificial Sequence
  Synthetic Polynucleotide
taatacgactcactatagggccgatagtgacgaatgaggctgcctttcccaacagaggagagggaaaatgagcctcattaacctggcggcagcgcaaaagatg

SEQ ID NO: 243877 - DNA, 103 bp, Artificial Sequence
  Synthetic Polynucleotide
taatacgactcactatagggcagtgtggatccgatagtgacgaatgaggcaacagaggagagcctcaatggtcactatcaacctggcggcagcgcaaaagatg

SEQ ID NO: 243878 - DNA, 103 bp, Artificial Sequence
  Synthetic Polynucleotide
taatacgactcactatagggggcttctccccagtgtggatccgatagtgaaacagaggagatcactaatggatccacacaacctggcggcagcgcaaaagatg

SEQ ID NO: 243879 - DNA, 103 bp, Artificial Sequence
  Synthetic Polynucleotide
taatacgactcactatagggacactgataaggcttctccccagtgtggataacagaggagaatccacatgggggagaagaacctggcggcagcgcaaaagatg

SEQ ID NO: 243880 - DNA, 103 bp, Artificial Sequence
  Synthetic Polynucleotide
taatacgactcactatagggcacattcgttacactgataaggcttctcccaacagaggagagggagaatgcttatcagtaacctggcggcagcgcaaaagatg

SEQ ID NO: 243881 - DNA, 103 bp, Artificial Sequence
  Synthetic Polynucleotide
taatacgactcactatagggaagctcttcccacattcgttacactgataaaacagaggagattatcaatgtaacgaatgaacctggcggcagcgcaaaagatg

SEQ ID NO: 243882 - DNA, 103 bp, Artificial Sequence
  Synthetic Polynucleotide
taatacgactcactatagggatgctgactgaagctcttcccacattcgttaacagaggagaaacgaaatggggaagagcaacctggcggcagcgcaaaagatg

SEQ ID NO: 243883 - DNA, 103 bp, Artificial Sequence
  Synthetic Polynucleotide
taatacgactcactatagggtgaggcccgcatgctgactgaagctcttccaacagaggagaggaagaatgtcagtcagcaacctggcggcagcgcaaaagatg

SEQ ID NO: 243884 - DNA, 103 bp, Artificial Sequence
  Synthetic Polynucleotide
taatacgactcactatagggcgctggcggaacatctccaggctaggaaggaacagaggagaccttccatgcctggagataacctggcggcagcgcaaaagatg

SEQ ID NO: 243885 - DNA, 103 bp, Artificial Sequence
  Synthetic Polynucleotide
taatacgactcactatagggtggtgggagctgaggcccgcatgctgactgaacagaggagacagtcaatgtgcgggcctaacctggcggcagcgcaaaagatg

SEQ ID NO: 243886 - DNA, 103 bp, Artificial Sequence
  Synthetic Polynucleotide
taatacgactcactataggggtggagtctctggtgggagctgaggcccgcaacagaggagagcgggcatgagctcccacaacctggcggcagcgcaaaagatg

SEQ ID NO: 243887 - DNA, 103 bp, Artificial Sequence
  Synthetic Polynucleotide
taatacgactcactatagggtctctccggtgtggagtctctggtgggagcaacagaggagagctcccatgagagactccaacctggcggcagcgcaaaagatg

SEQ ID NO: 243888 - DNA, 103 bp, Artificial Sequence
  Synthetic Polynucleotide
taatacgactcactatagggttatatggcttctctccggtgtggagtctcaacagaggagagagactatgcaccggagaaacctggcggcagcgcaaaagatg

SEQ ID NO: 243889 - DNA, 103 bp, Artificial Sequence
  Synthetic Polynucleotide
taatacgactcactatagggctccttacacttatatggcttctctccggtaacagaggagaaccggaatgaagccatataacctggcggcagcgcaaaagatg

SEQ ID NO: 243890 - DNA, 103 bp, Artificial Sequence
  Synthetic Polynucleotide
taatacgactcactatagggctttcccacactccttacacttatatggctaacagaggagaagccatatgagtgtaaggaacctggcggcagcgcaaaagatg

SEQ ID NO: 243891 - DNA, 103 bp, Artificial Sequence
  Synthetic Polynucleotide
taatacgactcactatagggtggttgaaggctttcccacactccttacacaacagaggagagtgtaaatggtgtgggaaaacctggcggcagcgcaaaagatg

SEQ ID NO: 243892 - DNA, 103 bp, Artificial Sequence
  Synthetic Polynucleotide
taatacgactcactataggggttggagctgtggttgaaggctttcccacaaacagaggagatgtgggatggccttcaacaacctggcggcagcgcaaaagatg

SEQ ID NO: 243893 - DNA, 103 bp, Artificial Sequence
  Synthetic Polynucleotide
taatacgactcactataggggtttattgaagttggagctgtggttgaaggaacagaggagaccttcaatgacagctccaaacctggcggcagcgcaaaagatg

SEQ ID NO: 243894 - DNA, 103 bp, Artificial Sequence
  Synthetic Polynucleotide
taatacgactcactatagggattctgtggtgtttattgaagttggagctgaacagaggagacagctcatgcttcaataaaacctggcggcagcgcaaaagatg

SEQ ID NO: 243895 - DNA, 103 bp, Artificial Sequence
  Synthetic Polynucleotide
taatacgactcactatagggctgcctgaagcgctggcggaacatctccagaacagaggagactggagatgttccgccagaacctggcggcagcgcaaaagatg

SEQ ID NO: 243896 - DNA, 103 bp, Artificial Sequence
  Synthetic Polynucleotide
taatacgactcactatagggcccggtgtggattctgtggtgtttattgaaaacagaggagattcaatatgcaccacagaaacctggcggcagcgcaaaagatg

SEQ ID NO: 243897 - DNA, 103 bp, Artificial Sequence
  Synthetic Polynucleotide
taatacgactcactatagggagggcttttccccggtgtggattctgtggtaacagaggagaaccacaatgtccacaccgaacctggcggcagcgcaaaagatg

SEQ ID NO: 243898 - DNA, 103 bp, Artificial Sequence
  Synthetic Polynucleotide
taatacgactcactatagggtgacaccagtagggcttttccccggtgtggaacagaggagaccacacatgggaaaagccaacctggcggcagcgcaaaagatg

SEQ ID NO: 243899 - DNA, 103 bp, Artificial Sequence
  Synthetic Polynucleotide
taatacgactcactatagggtccacagtgatgacaccagtagggcttttcaacagaggagagaaaagatgtactggtgtaacctggcggcagcgcaaaagatg

SEQ ID NO: 243900 - DNA, 103 bp, Artificial Sequence
  Synthetic Polynucleotide
taatacgactcactatagggagaaggtctttccacagtgatgacaccagtaacagaggagaactggtatgatcactgtgaacctggcggcagcgcaaaagatg

SEQ ID NO: 243901 - DNA, 103 bp, Artificial Sequence
  Synthetic Polynucleotide
taatacgactcactataggggacttgctacagaaggtctttccacagtgaaacagaggagatcactgatgaaagaccttaacctggcggcagcgcaaaagatg

SEQ ID NO: 243902 - DNA, 103 bp, Artificial Sequence
  Synthetic Polynucleotide
taatacgactcactatagggggaaagattggacttgctacagaaggtcttaacagaggagaaagaccatgtgtagcaagaacctggcggcagcgcaaaagatg

SEQ ID NO: 243903 - DNA, 103 bp, Artificial Sequence
  Synthetic Polynucleotide
taatacgactcactataggggctgatgtttggaaagattggacttgctacaacagaggagagtagcaatgccaatctttaacctggcggcagcgcaaaagatg

SEQ ID NO: 243904 - DNA, 103 bp, Artificial Sequence
  Synthetic Polynucleotide
taatacgactcactataggggtgtggactcgctgatgtttggaaagattgaacagaggagacaatctatgcaaacatcaaacctggcggcagcgcaaaagatg

SEQ ID NO: 243905 - DNA, 103 bp, Artificial Sequence
  Synthetic Polynucleotide
taatacgactcactatagggtccctctccagtgtggactcgctgatgtttaacagaggagaaaacatatgcgagtccacaacctggcggcagcgcaaaagatg

SEQ ID NO: 243906 - DNA, 103 bp, Artificial Sequence
  Synthetic Polynucleotide
taatacgactcactatagggggtacccaaactgcctgaagcgctggcggaaacagaggagatccgccatggcttcaggcaacctggcggcagcgcaaaagatg

SEQ ID NO: 243907 - DNA, 103 bp, Artificial Sequence
  Synthetic Polynucleotide
taatacgactcactatagggacggtgcttctccctctccagtgtggactcaacagaggagagagtccatgctggagaggaacctggcggcagcgcaaaagatg

SEQ ID NO: 243908 - DNA, 103 bp, Artificial Sequence
  Synthetic Polynucleotide
taatacgactcactatagggggggtatcatggtacccaaactgcctgaagaacagaggagacttcagatggtttgggtaaacctggcggcagcgcaaaagatg

SEQ ID NO: 243909 - DNA, 103 bp, Artificial Sequence
  Synthetic Polynucleotide
taatacgactcactatagggtcggggtccaggggtatcatggtacccaaaaacagaggagatttgggatgcatgataccaacctggcggcagcgcaaaagatg

SEQ ID NO: 243910 - DNA, 103 bp, Artificial Sequence
  Synthetic Polynucleotide
taatacgactcactatagggtcagggcctctcggggtccaggggtatcataacagaggagaatgataatgctggaccccaacctggcggcagcgcaaaagatg

SEQ ID NO: 243911 - DNA, 103 bp, Artificial Sequence
  Synthetic Polynucleotide
taatacgactcactatagggcggagttggctcagggcctctcggggtccaaacagaggagatggaccatgagaggccctaacctggcggcagcgcaaaagatg

SEQ ID NO: 243912 - DNA, 103 bp, Artificial Sequence
  Synthetic Polynucleotide
taatacgactcactataggggcagagcacccggagttggctcagggcctcaacagaggagagaggccatgagccaactcaacctggcggcagcgcaaaagatg

SEQ ID NO: 243913 - DNA, 103 bp, Artificial Sequence
  Synthetic Polynucleotide
taatacgactcactatagggggcccagaactggggccatgcctagtacctaacagaggagaaggtacatggcatggcccaacctggcggcagcgcaaaagatg

SEQ ID NO: 243914 - DNA, 103 bp, Artificial Sequence
  Synthetic Polynucleotide
taatacgactcactataggggccactcacagcagagcacccggagttggcaacagaggagagccaacatggggtgctctaacctggcggcagcgcaaaagatg

SEQ ID NO: 243915 - DNA, 103 bp, Artificial Sequence
  Synthetic Polynucleotide
taatacgactcactatagggtcgggcctcagccactcacagcagagcaccaacagaggagaggtgctatgctgtgagtgaacctggcggcagcgcaaaagatg

SEQ ID NO: 243916 - DNA, 103 bp, Artificial Sequence
  Synthetic Polynucleotide
taatacgactcactatagggggtgtggatctcgggcctcagccactcacaaacagaggagatgtgagatgctgaggcccaacctggcggcagcgcaaaagatg

SEQ ID NO: 243917 - DNA, 103 bp, Artificial Sequence
  Synthetic Polynucleotide
taatacgactcactatagggtctgctccttggtgtggatctcgggcctcaaacagaggagatgaggcatgagatccacaaacctggcggcagcgcaaaagatg

SEQ ID NO: 243918 - DNA, 103 bp, Artificial Sequence
  Synthetic Polynucleotide
taatacgactcactatagggagctccaggatctgctccttggtgtggatcaacagaggagagatccaatgcaaggagcaaacctggcggcagcgcaaaagatg

SEQ ID NO: 243919 - DNA, 103 bp, Artificial Sequence
  Synthetic Polynucleotide
taatacgactcactatagggcagcaccagtagctccaggatctgctccttaacagaggagaaaggagatgatcctggagaacctggcggcagcgcaaaagatg

SEQ ID NO: 243920 - DNA, 103 bp, Artificial Sequence
  Synthetic Polynucleotide
taatacgactcactatagggggaactgctccagcaccagtagctccaggaaacagaggagatcctggatgtactggtgcaacctggcggcagcgcaaaagatg

SEQ ID NO: 243921 - DNA, 103 bp, Artificial Sequence
  Synthetic Polynucleotide
taatacgactcactatagggaggatggtcaggaactgctccagcaccagtaacagaggagaactggtatgggagcagttaacctggcggcagcgcaaaagatg

SEQ ID NO: 243922 - DNA, 103 bp, Artificial Sequence
  Synthetic Polynucleotide
taatacgactcactatagggctcctggggcaggatggtcaggaactgctcaacagaggagagagcagatgctgaccatcaacctggcggcagcgcaaaagatg

SEQ ID NO: 243923 - DNA, 103 bp, Artificial Sequence
  Synthetic Polynucleotide
taatacgactcactatagggaggcctggagctcctggggcaggatggtcaaacagaggagatgaccaatgtgccccaggaacctggcggcagcgcaaaagatg

SEQ ID NO: 243924 - DNA, 103 bp, Artificial Sequence
  Synthetic Polynucleotide
taatacgactcactatagggggaggcctagggcccagaactggggccatgaacagaggagacatggcatgagttctgggaacctggcggcagcgcaaaagatg

SEQ ID NO: 243925 - DNA, 103 bp, Artificial Sequence
  Synthetic Polynucleotide
taatacgactcactatagggtcctgcacccaggcctggagctcctggggcaacagaggagagccccaatggctccaggcaacctggcggcagcgcaaaagatg

SEQ ID NO: 243926 - DNA, 103 bp, Artificial Sequence
  Synthetic Polynucleotide
taatacgactcactatagggcgggcaatgctcctgcacccaggcctggagaacagaggagactccagatgtgggtgcagaacctggcggcagcgcaaaagatg

SEQ ID NO: 243927 - DNA, 103 bp, Artificial Sequence
  Synthetic Polynucleotide
taatacgactcactatagggcagcgctctccgggcaatgctcctgcacccaacagaggagagggtgcatgagcattgccaacctggcggcagcgcaaaagatg

SEQ ID NO: 243928 - DNA, 103 bp, Artificial Sequence
  Synthetic Polynucleotide
taatacgactcactatagggacagcctcttcagcgctctccgggcaatgcaacagaggagagcattgatgggagagcgcaacctggcggcagcgcaaaagatg

SEQ ID NO: 243929 - DNA, 103 bp, Artificial Sequence
  Synthetic Polynucleotide
taatacgactcactataggggaggagagtgacagcctcttcagcgctctcaacagaggagagagagcatggaagaggctaacctggcggcagcgcaaaagatg

SEQ ID NO: 243930 - DNA, 103 bp, Artificial Sequence
  Synthetic Polynucleotide
taatacgactcactatagggccagatcttcgaggagagtgacagcctcttaacagaggagaaagaggatgtcactctccaacctggcggcagcgcaaaagatg

SEQ ID NO: 243931 - DNA, 103 bp, Artificial Sequence
  Synthetic Polynucleotide
taatacgactcactatagggagttcccgctccagatcttcgaggagagtgaacagaggagacactctatgcgaagatctaacctggcggcagcgcaaaagatg

SEQ ID NO: 243932 - DNA, 103 bp, Artificial Sequence
  Synthetic Polynucleotide
taatacgactcactatagggtggctcatccagttcccgctccagatcttcaacagaggagagaagatatggagcgggaaaacctggcggcagcgcaaaagatg

SEQ ID NO: 243933 - DNA, 103 bp, Artificial Sequence
  Synthetic Polynucleotide
taatacgactcactatagggcctggtgtcctggctcatccagttcccgctaacagaggagaagcgggatgtggatgagcaacctggcggcagcgcaaaagatg

SEQ ID NO: 243934 - DNA, 103 bp, Artificial Sequence
  Synthetic Polynucleotide
taatacgactcactatagggggagttgagacctggtgtcctggctcatccaacagaggagaggatgaatgaggacaccaaacctggcggcagcgcaaaagatg

SEQ ID NO: 243935 - DNA, 103 bp, Artificial Sequence
  Synthetic Polynucleotide
taatacgactcactatagggctgctcctgtggaggcctagggcccagaacaacagaggagagttctgatgcctaggcctaacctggcggcagcgcaaaagatg

SEQ ID NO: 243936 - DNA, 103 bp, Artificial Sequence
  Synthetic Polynucleotide
taatacgactcactatagggttcgtttggaggagttgagacctggtgtccaacagaggagaggacacatggtctcaactaacctggcggcagcgcaaaagatg

SEQ ID NO: 243937 - DNA, 103 bp, Artificial Sequence
  Synthetic Polynucleotide
taatacgactcactatagggccggtttctgttcgtttggaggagttgagaaacagaggagatctcaaatgctccaaacgaacctggcggcagcgcaaaagatg

SEQ ID NO: 243938 - DNA, 103 bp, Artificial Sequence
  Synthetic Polynucleotide
taatacgactcactatagggttctcccacaccggtttctgttcgtttggaaacagaggagatccaaaatgacagaaaccaacctggcggcagcgcaaaagatg

SEQ ID NO: 243939 - DNA, 103 bp, Artificial Sequence
  Synthetic Polynucleotide
taatacgactcactatagggggaggatatcttctcccacaccggtttctgaacagaggagacagaaaatggtgtgggagaacctggcggcagcgcaaaagatg

SEQ ID NO: 243940 - DNA, 103 bp, Artificial Sequence
  Synthetic Polynucleotide
taatacgactcactatagggcagttcctgaggaggatatcttctcccacaaacagaggagatgtgggatgagatatcctaacctggcggcagcgcaaaagatg

SEQ ID NO: 243941 - DNA, 103 bp, Artificial Sequence
  Synthetic Polynucleotide
taatacgactcactataggggattcctttgcagttcctgaggaggatatcaacagaggagagatatcatgctcaggaacaacctggcggcagcgcaaaagatg

SEQ ID NO: 243942 - DNA, 103 bp, Artificial Sequence
  Synthetic Polynucleotide
taatacgactcactataggggctgctcggggattcctttgcagttcctgaaacagaggagatcaggaatggcaaaggaaaacctggcggcagcgcaaaagatg

SEQ ID NO: 243943 - DNA, 103 bp, Artificial Sequence
  Synthetic Polynucleotide
taatacgactcactataggggtggctgcatgctgctcggggattcctttgaacagaggagacaaaggatgccccgagcaaacctggcggcagcgcaaaagatg

SEQ ID NO: 243944 - DNA, 103 bp, Artificial Sequence
  Synthetic Polynucleotide
taatacgactcactatagggtccaagggctgtggctgcatgctgctcgggaacagaggagacccgagatgcatgcagccaacctggcggcagcgcaaaagatg

SEQ ID NO: 243945 - DNA, 103 bp, Artificial Sequence
  Synthetic Polynucleotide
taatacgactcactataggggtgactggtctccaagggctgtggctgcataacagaggagaatgcagatgcagcccttgaacctggcggcagcgcaaaagatg

SEQ ID NO: 243946 - DNA, 103 bp, Artificial Sequence
  Synthetic Polynucleotide
taatacgactcactataggggaggccccacctgctcctgtggaggcctagaacagaggagactaggcatgcacaggagcaacctggcggcagcgcaaaagatg

SEQ ID NO: 243947 - DNA, 103 bp, Artificial Sequence
  Synthetic Polynucleotide
taatacgactcactatagggactcgtatttgtgactggtctccaagggctaacagaggagaagccctatgagaccagtcaacctggcggcagcgcaaaagatg

SEQ ID NO: 243948 - DNA, 103 bp, Artificial Sequence
  Synthetic Polynucleotide
taatacgactcactatagggggcccccaagactcgtatttgtgactggtcaacagaggagagaccagatgcaaatacgaaacctggcggcagcgcaaaagatg

SEQ ID NO: 243949 - DNA, 103 bp, Artificial Sequence
  Synthetic Polynucleotide
taatacgactcactataggggatgtacaggggcccccaagactcgtatttaacagaggagaaaatacatgtcttgggggaacctggcggcagcgcaaaagatg

SEQ ID NO: 243950 - DNA, 103 bp, Artificial Sequence
  Synthetic Polynucleotide
taatacgactcactatagggcagactcttggatgtacaggggcccccaagaacagaggagacttgggatgccctgtacaaacctggcggcagcgcaaaagatg

SEQ ID NO: 243951 - DNA, 103 bp, Artificial Sequence
  Synthetic Polynucleotide
taatacgactcactatagggtgctcctcaccagactcttggatgtacaggaacagaggagacctgtaatgccaagagtcaacctggcggcagcgcaaaagatg

SEQ ID NO: 243952 - DNA, 103 bp, Artificial Sequence
  Synthetic Polynucleotide
taatacgactcactatagggagcgaactcctgctcctcaccagactcttgaacagaggagacaagagatgggtgaggagaacctggcggcagcgcaaaagatg

SEQ ID NO: 243953 - DNA, 103 bp, Artificial Sequence
  Synthetic Polynucleotide
taatacgactcactatagggttggatcttgagcgaactcctgctcctcacaacagaggagagtgaggatgaggagttcgaacctggcggcagcgcaaaagatg

SEQ ID NO: 243954 - DNA, 103 bp, Artificial Sequence
  Synthetic Polynucleotide
taatacgactcactatagggcggacctttcttggatcttgagcgaactccaacagaggagaggagttatgtcaagatccaacctggcggcagcgcaaaagatg

SEQ ID NO: 243955 - DNA, 103 bp, Artificial Sequence
  Synthetic Polynucleotide
taatacgactcactatagggtctgcaatctcggacctttcttggatcttgaacagaggagacaagatatgagaaaggtcaacctggcggcagcgcaaaagatg

SEQ ID NO: 243956 - DNA, 103 bp, Artificial Sequence
  Synthetic Polynucleotide
taatacgactcactataggggggtactcaatctgcaatctcggacctttcaacagaggagagaaaggatggagattgcaaacctggcggcagcgcaaaagatg

SEQ ID NO: 243957 - DNA, 103 bp, Artificial Sequence
  Synthetic Polynucleotide
taatacgactcactatagggtttaccatcagaggccccacctgctcctgtaacagaggagaacaggaatgggtggggccaacctggcggcagcgcaaaagatg

SEQ ID NO: 243958 - DNA, 103 bp, Artificial Sequence
  Synthetic Polynucleotide
taatacgactcactatagggtcctcgtgctgggtactcaatctgcaatctaacagaggagaagattgatgattgagtacaacctggcggcagcgcaaaagatg

SEQ ID NO: 243959 - DNA, 103 bp, Artificial Sequence
  Synthetic Polynucleotide
taatacgactcactatagggatctgctgattcctcgtgctgggtactcaaaacagaggagattgagtatgcagcacgagaacctggcggcagcgcaaaagatg

SEQ ID NO: 243960 - DNA, 103 bp, Artificial Sequence
  Synthetic Polynucleotide
taatacgactcactatagggctttctgctcatctgctgattcctcgtgctaacagaggagaagcacgatgaatcagcagaacctggcggcagcgcaaaagatg

SEQ ID NO: 243961 - DNA, 103 bp, Artificial Sequence
  Synthetic Polynucleotide
taatacgactcactataggggcttcagaacctttctgctcatctgctgataacagaggagaatcagcatgtgagcagaaaacctggcggcagcgcaaaagatg

SEQ ID NO: 243962 - DNA, 103 bp, Artificial Sequence
  Synthetic Polynucleotide
taatacgactcactataggggagcccctctgcttcagaacctttctgctcaacagaggagagagcagatgggttctgaaaacctggcggcagcgcaaaagatg

SEQ ID NO: 243963 - DNA, 103 bp, Artificial Sequence
  Synthetic Polynucleotide
taatacgactcactatagggtatcccctttgagcccctctgcttcagaacaacagaggagagttctgatgcagaggggcaacctggcggcagcgcaaaagatg

SEQ ID NO: 243964 - DNA, 103 bp, Artificial Sequence
  Synthetic Polynucleotide
taatacgactcactatagggacagaaattatatcccctttgagcccctctaacagaggagaagagggatgcaaaggggaaacctggcggcagcgcaaaagatg

SEQ ID NO: 243965 - DNA, 103 bp, Artificial Sequence
  Synthetic Polynucleotide
taatacgactcactatagggggcgataatcacagaaattatatcccctttaacagaggagaaaagggatgataatttctaacctggcggcagcgcaaaagatg

SEQ ID NO: 243966 - DNA, 103 bp, Artificial Sequence
  Synthetic Polynucleotide
taatacgactcactatagggcaggtttattggcgataatcacagaaattaaacagaggagataatttatgtgattatcgaacctggcggcagcgcaaaagatg

SEQ ID NO: 243967 - DNA, 103 bp, Artificial Sequence
  Synthetic Polynucleotide
taatacgactcactatagggaagctggcctcaggtttattggcgataatcaacagaggagagattatatgcaataaaccaacctggcggcagcgcaaaagatg

SEQ ID NO: 243968 - DNA, 103 bp, Artificial Sequence
  Synthetic Polynucleotide
taatacgactcactatagggctcctcgacttttaccatcagaggccccacaacagaggagagtggggatgctgatggtaaacctggcggcagcgcaaaagatg

SEQ ID NO: 243969 - DNA, 103 bp, Artificial Sequence
  Synthetic Polynucleotide
taatacgactcactatagggctgcctctctaagctggcctcaggtttattaacagaggagaaataaaatggaggccagcaacctggcggcagcgcaaaagatg

SEQ ID NO: 243970 - DNA, 103 bp, Artificial Sequence
  Synthetic Polynucleotide
taatacgactcactatagggggtttacgcactgcctctctaagctggcctaacagaggagaaggccaatgtagagaggcaacctggcggcagcgcaaaagatg

SEQ ID NO: 243971 - DNA, 103 bp, Artificial Sequence
  Synthetic Polynucleotide
taatacgactcactatagggtcattttcaaggtttacgcactgcctctctaacagaggagaagagagatggtgcgtaaaaacctggcggcagcgcaaaagatg

SEQ ID NO: 243972 - DNA, 103 bp, Artificial Sequence
  Synthetic Polynucleotide
taatacgactcactatagggtgttcctttttcattttcaaggtttacgcaaacagaggagatgcgtaatgcttgaaaataacctggcggcagcgcaaaagatg

SEQ ID NO: 243973 - DNA, 103 bp, Artificial Sequence
  Synthetic Polynucleotide
taatacgactcactataggggagggggttttgttcctttttcattttcaaaacagaggagattgaaaatgaaaaaggaaaacctggcggcagcgcaaaagatg

SEQ ID NO: 243974 - DNA, 103 bp, Artificial Sequence
  Synthetic Polynucleotide
taatacgactcactataggggcctcttgaagagggggttttgttccttttaacagaggagaaaaaggatgaaaacccccaacctggcggcagcgcaaaagatg

SEQ ID NO: 243975 - DNA, 103 bp, Artificial Sequence
  Synthetic Polynucleotide
taatacgactcactatagggcttggagcctgcctcttgaagagggggtttaacagaggagaaaacccatgcttcaagagaacctggcggcagcgcaaaagatg

SEQ ID NO: 243976 - DNA, 103 bp, Artificial Sequence
  Synthetic Polynucleotide
taatacgactcactatagggctctacctttcttggagcctgcctcttgaaaacagaggagattcaagatgcaggctccaaacctggcggcagcgcaaaagatg

SEQ ID NO: 243977 - DNA, 103 bp, Artificial Sequence
  Synthetic Polynucleotide
taatacgactcactatagggggaactgattctctacctttcttggagcctaacagaggagaaggctcatggaaaggtagaacctggcggcagcgcaaaagatg

SEQ ID NO: 243978 - DNA, 103 bp, Artificial Sequence
  Synthetic Polynucleotide
taatacgactcactatagggaggtttagtaggaactgattctctacctttaacagaggagaaaaggtatggaatcagttaacctggcggcagcgcaaaagatg

SEQ ID NO: 243979 - DNA, 103 bp, Artificial Sequence
  Synthetic Polynucleotide
taatacgactcactatagggtctcttctttctcctcgacttttaccatcaaacagaggagatgatggatgaagtcgaggaacctggcggcagcgcaaaagatg

SEQ ID NO: 243980 - DNA, 103 bp, Artificial Sequence
  Synthetic Polynucleotide
taatacgactcactatagggctcctggggtaggtttagtaggaactgattaacagaggagaaatcagatgctactaaacaacctggcggcagcgcaaaagatg

SEQ ID NO: 243981 - DNA, 103 bp, Artificial Sequence
  Synthetic Polynucleotide
taatacgactcactatagggtaacgtctctctcctggggtaggtttagtaaacagaggagatactaaatgtaccccaggaacctggcggcagcgcaaaagatg

SEQ ID NO: 243982 - DNA, 103 bp, Artificial Sequence
  Synthetic Polynucleotide
taatacgactcactatagggagcacatatataacgtctctctcctggggtaacagaggagaaccccaatggagagacgtaacctggcggcagcgcaaaagatg

SEQ ID NO: 243983 - DNA, 103 bp, Artificial Sequence
  Synthetic Polynucleotide
taatacgactcactatagggtgccacattcagcacatatataacgtctctaacagaggagaagagacatgatatatgtgaacctggcggcagcgcaaaagatg

SEQ ID NO: 243984 - DNA, 103 bp, Artificial Sequence
  Synthetic Polynucleotide
taatacgactcactatagggctaaaggctttgccacattcagcacatataaacagaggagatatatgatgtgaatgtggaacctggcggcagcgcaaaagatg

SEQ ID NO: 243985 - DNA, 103 bp, Artificial Sequence
  Synthetic Polynucleotide
taatacgactcactatagggtgagctattactaaaggctttgccacattcaacagaggagagaatgtatgaaagcctttaacctggcggcagcgcaaaagatg

SEQ ID NO: 243986 - DNA, 103 bp, Artificial Sequence
  Synthetic Polynucleotide
taatacgactcactatagggtggtgagatttgagctattactaaaggcttaacagaggagaaagcctatggtaatagctaacctggcggcagcgcaaaagatg

SEQ ID NO: 243987 - DNA, 103 bp, Artificial Sequence
  Synthetic Polynucleotide
taatacgactcactatagggctcctgtgtttggtgagatttgagctattaaacagaggagataatagatgaaatctcacaacctggcggcagcgcaaaagatg

SEQ ID NO: 243988 - DNA, 103 bp, Artificial Sequence
  Synthetic Polynucleotide
taatacgactcactatagggagtgtgtgttctcctgtgtttggtgagattaacagaggagaaatctcatgaaacacaggaacctggcggcagcgcaaaagatg

SEQ ID NO: 243989 - DNA, 103 bp, Artificial Sequence
  Synthetic Polynucleotide
taatacgactcactataggggtttctccccagtgtgtgttctcctgtgttaacagaggagaaacacaatggaacacacaaacctggcggcagcgcaaaagatg

SEQ ID NO: 243990 - DNA, 103 bp, Artificial Sequence
  Synthetic Polynucleotide
taatacgactcactatagggtacttgcctttctcttctttctcctcgactaacagaggagaagtcgaatggaaagaagaaacctggcggcagcgcaaaagatg

SEQ ID NO: 243991 - DNA, 103 bp, Artificial Sequence
  Synthetic Polynucleotide
taatacgactcactatagggcacacgtaaggtttctccccagtgtgtgttaacagaggagaaacacaatgtggggagaaaacctggcggcagcgcaaaagatg

SEQ ID NO: 243992 - DNA, 103 bp, Artificial Sequence
  Synthetic Polynucleotide
taatacgactcactatagggacacttggtgcacacgtaaggtttctccccaacagaggagaggggagatgccttacgtgaacctggcggcagcgcaaaagatg

SEQ ID NO: 243993 - DNA, 103 bp, Artificial Sequence
  Synthetic Polynucleotide
taatacgactcactatagggaagctttcccacacttggtgcacacgtaagaacagaggagacttacgatggcaccaagtaacctggcggcagcgcaaaagatg

SEQ ID NO: 243994 - DNA, 103 bp, Artificial Sequence
  Synthetic Polynucleotide
taatacgactcactatagggctgtggctgaaagctttcccacacttggtgaacagaggagacaccaaatgtgggaaagcaacctggcggcagcgcaaaagatg

SEQ ID NO: 243995 - DNA, 103 bp, Artificial Sequence
  Synthetic Polynucleotide
taatacgactcactataggggaggtttgagctgtggctgaaagctttcccaacagaggagagggaaaatgttcagccacaacctggcggcagcgcaaaagatg

SEQ ID NO: 243996 - DNA, 103 bp, Artificial Sequence
  Synthetic Polynucleotide
taatacgactcactatagggagtggagggtgaggtttgagctgtggctgaaacagaggagatcagccatggctcaaaccaacctggcggcagcgcaaaagatg

SEQ ID NO: 243997 - DNA, 103 bp, Artificial Sequence
  Synthetic Polynucleotide
taatacgactcactatagggtgtgttctgtagtggagggtgaggtttgagaacagaggagactcaaaatgcaccctccaaacctggcggcagcgcaaaagatg

SEQ ID NO: 243998 - DNA, 103 bp, Artificial Sequence
  Synthetic Polynucleotide
taatacgactcactataggggtccaccaagtgtgttctgtagtggagggtaacagaggagaaccctcatgtacagaacaaacctggcggcagcgcaaaagatg

SEQ ID NO: 243999 - DNA, 103 bp, Artificial Sequence
  Synthetic Polynucleotide
taatacgactcactatagggcatagggccggtccaccaagtgtgttctgtaacagaggagaacagaaatgacttggtggaacctggcggcagcgcaaaagatg

SEQ ID NO: 244000 - DNA, 103 bp, Artificial Sequence
  Synthetic Polynucleotide
taatacgactcactatagggcacttacagtcatagggccggtccaccaagaacagaggagacttggtatgccggccctaaacctggcggcagcgcaaaagatg

SEQ ID NO: 244001 - DNA, 20 bp, Artificial Sequence
  Synthetic Polynucleotide
taatacgactcactataggg

SEQ ID NO: 244002 - DNA, 11 bp, Artificial Sequence
  Synthetic Polynucleotide
aacagaggaga

SEQ ID NO: 244003 - DNA, 21 bp, Artificial Sequence
  Synthetic Polynucleotide
aacctggcggcagcgcaaaag

SEQ ID NO: 244004 - DNA, 30 bp, Artificial Sequence
  Synthetic Polynucleotide
ccgacacctgtttcatggaacaataaaaga

SEQ ID NO: 244005 - DNA, 30 bp, Artificial Sequence
  Synthetic Polynucleotide
tgctgtctgtgaaacagataaatggaaata

SEQ ID NO: 244006 - DNA, 30 bp, Artificial Sequence
  Synthetic Polynucleotide
tccctttcccagaaataaacttttttaccc

SEQ ID NO: 244007 - DNA, 30 bp, Artificial Sequence
  Synthetic Polynucleotide
tcactgagtcattgccatctgcagaatcag

SEQ ID NO: 244008 - DNA, 30 bp, Artificial Sequence
  Synthetic Polynucleotide
tccaagacccaaagttctgggaactggtgg

SEQ ID NO: 244009 - DNA, 30 bp, Artificial Sequence
  Synthetic Polynucleotide
tggcaattgtagatataacttctggtaaat

SEQ ID NO: 244010 - DNA, 30 bp, Artificial Sequence
  Synthetic Polynucleotide
atccaaatataatgatgacctatatgccct

SEQ ID NO: 244011 - DNA, 30 bp, Artificial Sequence
  Synthetic Polynucleotide
ccaatatgagatctgtaatgctaacagttt

SEQ ID NO: 244012 - DNA, 30 bp, Artificial Sequence
  Synthetic Polynucleotide
gtcatataaaggaagaagataggagaagaa

SEQ ID NO: 244013 - DNA, 30 bp, Artificial Sequence
  Synthetic Polynucleotide
agttcacaagagatggttcatggtgttcca

SEQ ID NO: 244014 - DNA, 30 bp, Artificial Sequence
  Synthetic Polynucleotide
aaaggttagcttatgttacatatcaagata

SEQ ID NO: 244015 - DNA, 30 bp, Artificial Sequence
  Synthetic Polynucleotide
aatcactgaaaattggagttaggtattgac

SEQ ID NO: 244016 - DNA, 30 bp, Artificial Sequence
  Synthetic Polynucleotide
ggtatgttaagtatgaggccttatccgtac

SEQ ID NO: 244017 - DNA, 30 bp, Artificial Sequence
  Synthetic Polynucleotide
tcaagttagagaaggaagtggctgagaccc

SEQ ID NO: 244018 - DNA, 30 bp, Artificial Sequence
  Synthetic Polynucleotide
taaatctatgagagatcaacgaaaaggaag

SEQ ID NO: 244019 - DNA, 30 bp, Artificial Sequence
  Synthetic Polynucleotide
aaagaagaaatcatgcaagaaaacaaaggg

SEQ ID NO: 244020 - DNA, 20 bp, Artificial Sequence
  Synthetic Polynucleotide
ctctgggctaactgtcgcgc

SEQ ID NO: 244021 - DNA, 20 bp, Artificial Sequence
  Synthetic Polynucleotide
taatacgactcactataggg

SEQ ID NO: 244022 - DNA, 20 bp, Artificial Sequence
  Synthetic Polynucleotide
aaccaaacacacaaacgcac

SEQ ID NO: 244023 - DNA, 11 bp, Artificial Sequence
  Synthetic Polynucleotide
aacagaggaga

SEQ ID NO: 244024 - DNA, 21 bp, Artificial Sequence
  Synthetic Polynucleotide
aacctggcggcagcgcaaaag

SEQ ID NO: 244025 - DNA, 15 bp, Artificial Sequence
  Synthetic Polynucleotide
atgcgtaaaggagaa

SEQ ID NO: 244026 - DNA, 30 bp, Artificial Sequence
  Synthetic Polynucleotide
cgtctcgtcttctcctttacgcatcttttg

SEQ ID NO: 244027 - DNA, 27 bp, Artificial Sequence
  Synthetic Polynucleotide
cgtctcgtgctctgggctaactgtcgc

SEQ ID NO: 244028 - DNA, 69 bp, Artificial Sequence
  Synthetic Polynucleotide
cgtctcgtgctctgggctaactgtcgcgctaatacgactcactatagggaaccaaacacacaaacgcac
